United States Patent 9,675,668 (MODIFIED POLYNUCLEOTIDES ENCODING HEPATITIS A VIRUS CELLULAR RECEPTOR 2) - sequence listing, part 3

SEQ ID NO: 1851 - DNA, 7161 bp, Homo sapiens
tcagaatcagatgtacctcttttctgccttcctatgggagctactattgagtgctgggatcctgaaaccaaatatccacttccagttttttcaacttttgtcttgacaggttcttcagccaaaaaggtatatggagctgccattcagttttatgaaccttactctcgggaacttctatcagagaaacagcttatgcacctgggcttgttgacgcctgtggagagaaaaatggtctccaaatccatcaatacaaacaaatgcatttgtttactctcacactggcctttttttgaagcttttaggaaatttcttatgtttatctacaaactttctgtgtctggaccacatcctcttcccattgaaaagcacatttcacattttatgcaaaacatcccttttccttcaccacaaagaccgagaatccttgtccagctgtcagtccatgatgcattaatattatcacagccagtttctacacctttaccactaagtggagccaactttagcaccttgctaatgaatctgggtcctgagaattgtgcaacactgctgctctttgttttacttgagagtaaaattctgctgcattctcttaggccagctgtcttgactggggtagctgaagctgttgtagctatgatctttccatttcagtggcaatgcccatatattcccctttgtcctctttcactggctgcagtgcttagtgcacctttaccatttatagttggagttgactcaaggtattttgatcttcatgacccaccacaagatgttgtttgcattgacttggatacgaacatgttatatgtatcagatgaaaagaagaacatgaactggaagcaacttcccaaaaagccgtgcaaaaatctacttagcaccttaaagaaattgtatccccagctgtcttcagttcaccaaaaaactcaagaaggctcagcgattgacatgactccaattgaagcagatttctcctggcaaaagaagatgacacagcttgagatggaaattcaagaggcatttttgcgctttatggcgtctattttaaaaggatatagaacatatctcagaccaatcacagaggctccttcaaataaagccacagctgctgattcattgtttgaccgacagggatttttaaaaagtcgagatcgtgcctatgcaaaattctatacccttttatccaaaacacagatttttattcgtttcattgaagaatgcagttttgtaagtgataaagatactggattagcattttttgatgactgcatagaaaagttgtttcctgataaaggcacagagaaaacagataaggttgattttgattcagcagaagataccagattgatagaactagatgattcacagaaaagtgagcatactgtatttataatgccgccagagccacctcctgatgatggaaaggacctgtcaccaaagtacagttacaaatactttccaagactggaccttaagctttttgacagaccgcaggagttgaaactttgttttagtagacaccctactgggaatagcattacaaagagtccacctctcatggctaagagaactaaacaggaaataaaaacagctcataaattggcgaagagatgttatacaaatccaccacagtgggccaagtgtctgtttagtcattgttacagtttatggtttatttgtcttccggcctatgttagagtttctcatcctaaagtcagagcacttcagcaggcatatgatgtacttattaagatgaggaaaacagatgtggatcccttagatgaggtgtgctatcgagtagtgatgcagctttgtggactttggggtcatcctgttttagcagtgagagtcttatttgaaatgaaaactgctaggataaagcctaatgctattacttatggttattataataaggtagtcttggagagcccgtggcctagcagtacccgcagtggtattttcttatggacgaaggtacggaatgtggtacgtggcttggcacagtttaggcagccgcttaaaaagactgtgcaaaggtcacaggtctcctcaatatcagctcttcaaaatgtcacaggtggaagtgatggggacacggtgagccacggtagtgtggatagttctaatgatgctaacaatggggagcacacagtcttcgtcagagatttaatcaggcttgagtccattgataatcactctagcacaggtggtcagtctgaccaaggatacgggtctaaggatgaacttataaaggatgatgcagaaattcatgtgcctgaagaacaggcagcaagagaattgataactaaaacaaaaatgcaaacagaagaggtgtgtgatgcctctgctattgtggcaaaacattcacaacctagtccagagcctcacagtcctactgaacctcctgcatggggcagcagtattgtgaaagttccgtctggtatatttgatgtcaacagcaggaaaagtagtatatcaaatgtgctgttttctactcaagatccagttgaagatgcagtctttggcgaagctactaatctcaagaagaatggtgatagaggagaaaaaagacaaaagcattttcctgagaggagttgtagttttagttctgaaagtcgagcaggaatgttgcttaagaagagtagtttggattcgaattcaagtgaaatggctatcatgatgggagcagatgccaagattctcacagcagcattgacatgtcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacagcttcctctgtcatctctgtcccaggatagcaaacttgtgtatattcagctgttatgggataatatcaaccttcatcaggaaccaagagaacctctgtatgtctcatggaggaattttaattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaaggagtttatacagagaaatcctcttcttatcattagtgtctctaggaagagagaatattgatattgaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggcttggggattagatttcatctggaaacattcaagtttttttttccaaatcgtaagaactggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccgggcacggtggctcaggcctgtaatcccagcactttgggaggctgagcaaggtgggtggatcacttgaggccaggagttcgagaccagcctggccaacacggtgagaccctgtctttactaaaaatacaaaaattagccaggcgcaccactgtagtcccagctactcaggctgaggcaggagaatcgcttgaactgaggcagaggctacagtgagtggagatcacgccactgcaactccagcttgggtgacagagtgagaccgtctcaaaaaaaaaaaaaaaaaaaaaagagagcaacatatttgtgtaagtttgtatatgtgtagggctgtgtaggtatgtgtatatacagccatattctaagtgtatatttattaaaatagattgcatgttgcaatacggttttctgaaaggggtctcattgactattaaataaatgactactactaaacttgtctgtagtcattaatcttaaaattacctgaaaatctgatgacagctgccttccctaactttaatgtattaggttggcacaaaattaattgtagtttttgccactattaatggcaaaaaccgcaattatttttgtaccaacataatacacctttcatattatgtattatcttgcttaatgggttttatcttgattatccagttacttccatcctcttcccaatgttaatttgcaatagttttaaaatgggaacaaatgaatcaatcatcagatagttaaaatgaaattaaatcagctgcctaataatttatggaattcattggaatgtgcttaaaatgctaaagtgtatgtcattgaacatgaaatcttttttcaggcacatacattgttggtattgatgactttttaaaacctgtgggataaacttgcactgcacacggaagttttattcttgtatatttagatttgtatgcttgtgagtaaaaatgtgcatttgtaaatactgtgtttttaggttgaatcaattaagtcttaaaactgtaaatttattaagcttgttgccagtaggtttaagaaaatcatgatctcacatgcctcactttgacatttatcatgccttttattaaaaatatcccttaggaacagtaagtttgccttaactctctgcatggtttaaaaagccattggttttgtgtgtgtttacagtaattatgcagatgactaaatgagttgacacagtaaaattacttccatatggtacagtaacaacctaactcccttctacctgatgtaaccatttacaaattatagttattgtaccagtctttcaacatttcagggttaatctgacctatgcagaattctagtgtgaatttattgtgaaaatgctaaatgaaacaatttgtcagaaattatgtacaattttcattaccttcaaaatggatcttttgcactgtctgagagtatatatttttgcaactcaagacttggtactagttttaatacttaacacttactgacccaacagaagtttggaattaccttgcatataaaaattgaggttgaataaaatgaaaaattgttgttttctgttaca

SEQ ID NO: 1852 - DNA, 3463 bp, Homo sapiens
ggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacagcttcctctgtcatctctgtcccaggatagcaaacttgtgtatattcagctgttatgggataatatcaaccttcatcaggaaccaagagaacctctgtatgtctcatggaggaattttaattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaaggagtttatacagagaaatcctcttcttatcattagtgtctctaggaagagagaatattgatattgaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggcttggggattagatttcatctggaaacattcaagtttttttttccaaatcgtaagaactggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccgggcacggtggctcaggcctgtaatcccagcactttgggaggctgagcaaggtgggtggatcacttgaggccaggagttcgagaccagcctggccaacacggtgagaccctgtctttactaaaaatacaaaaattagccaggcgcaccactgtagtcccagctactcaggctgaggcaggagaatcgcttgaactgaggcagaggctacagtgagtggagatcacgccactgcaactccagcttgggtgacagagtgagaccgtctcaaaaaaaaaaaaaaaaaaaaaagagagcaacatatttgtgtaagtttgtatatgtgtagggctgtgtaggtatgtgtatatacagccatattctaagtgtatatttattaaaatagattgcatgttgcaatacggttttctgaaaggggtctcattgactattaaataaatgactactactaaacttgtctgtagtcattaatcttaaaattacctgaaaatctgatgacagctgccttccctaactttaatgtattaggttggcacaaaattaattgtagtttttgccactattaatggcaaaaaccgcaattatttttgtaccaacataatacacctttcatattatgtattatcttgcttaatgggttttatcttgattatccagttacttccatcctcttcccaatgttaatttgcaatagttttaaaatgggaacaaatgaatcaatcatcagatagttaaaatgaaattaaatcagctgcctaataatttatggaattcattggaatgtgcttaaaatgctaaagtgtatgtcattgaacatgaaatcttttttcaggcacatacattgttggtattgatgactttttaaaacctgtgggataaacttgcactgcacacggaagttttattcttgtatatttagatttgtatgcttgtgagtaaaaatgtgcatttgtaaa

SEQ ID NO: 1853 - DNA, 1547 bp, Homo sapiens
atgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaaggtatcaaagggtacagagacctctttatgtagtaataaatggggtacccttgtaaaaattctgtctctaaagacaacctgactcatataggcataagttctggcatttaagagtacatcttaacttattaccacatagtgtttaacgagctaatgaatgaatctgatgataaaccatttttgaactaagtttaatattttacagttgtcttttacaaaatgaacttctcaacagtaaaatatttcccttttaatatagtcattgccagtttccagaggcgaaatgttctctttctgtgaaatgtacacttggcccttaaatactaattgaatcaaacatttattgagactctattgtatgctaaatattatgctaagctctaaaaataaaaaagtaaatatgactgggtctctctccttaggtggatcgtggcctagtagagattaaatacttgtcagtgtctttattgtacttatttgcatatagcatacttctaggtaattttgtttaataaagatgaaataatatttgagtaaagcaa

SEQ ID NO: 1854 - DNA, 3479 bp, Homo sapiens
cacaacctagtccagagcctcacagtcctactgaacctcctgcatggggcagcagtattgtgaaagttccgtctggtatatttgatgtcaacagcaggaaaagtagcactggtagtatatcaaatgtgctgttttctactcaagatccagttgaagatgcagtctttggcgaagctactaatctcaagaagaatggtgatagaggagaaaaaagacaaaagcattttcctgagaggagttgtagttttagttctgaaagtcgagcaggaatgttgcttaagaagagtagtttggattcgaattcaagtgaaatggctatcatgatgggagcagatgccaagattctcacagcagcattgacatgtcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacagcttcctctgtcatctctgtcccaggatagcaaacttgtgtatattcagctgttatgggataatatcaaccttcatcaggaaccaagagaacctctgtatgtctcatggaggaattttaattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaagaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggcttggggattagatttcatctggaaacattcaagtttttttttccaaatcgtaagaactggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccgggcacggtggctcaggcctgtaatcccagcactttgggaggctgagcaaggtgggtggatcacttgaggccaggagttcgagaccagcctggccaacacggtgagaccctgtctttactaaaaatacaaaaattagccaggcgcaccactgtagtcccagctactcaggctgaggcaggagaatcgcttgaactgaggcagaggctacagtgagtggagatcacgccactgcaactccagcttgggtgacagagtgagaccgtctcaaaaaaaaaaaaaaaaaaaaaa

SEQ ID NO: 1855 - DNA, 5169 bp, Homo sapiens
gttagagtttctcatcctaaagtcagagcacttcagcaggcatatgatgtacttattaagatgaggaaaacagatgtggatcccttagatgaggtgtgctatcgagtagtgatgcagctttgtggactttggggtcatcctgttttagcagtgagagtcttatttgaaatgaaaactgctaggataaagcctaatgctattacttatggttattataataaggtagtcttggagagcccgtggcctagcagtacccgcagtggtattttcttatggacgaaggtacggaatgtggtacgtggcttggcacagtttaggcagccgcttaaaaagactgtgcaaaggtcacaggtctcctcaatatcagctcttcaaaatgtcacaggtggaagtgatggggacacggtgagccacggtagtgtggatagttctaatgatgctaacaatggggagcacacagtcttcgtcagagatttaatcaggcttgagtccattgataatcactctagcacaggtggtcagtctgaccaaggatacgggtctaaggatgaacttataaaggatgatgcagaaattcatgtgcctgaagaacaggcagcaagagaattgataactaaaacaaaaatgcaaacagaagaggtgtgtgatgcctctgctattgtggcaaaacattcacaacctagtccagagcctcacagtcctactgaacctcctgcatggggcagcagtattgtgaaagttccgtctggtatatttgatgtcaacagcaggaaaagtagtatatcaaatgtgctgttttctactcaagatccagttgaagatgcagtctttggcgaagctactaatctcaagaagaatggtgatagaggagaaaaaagacaaaagcattttcctgagaggagttgtagttttagttctgaaagtcgagcaggaatgttgcttaagaagagtagtttggattcgaattcaagtgaaatggctatcatgatgggagcagatgccaagattctcacagcagcattgacatgtcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacagcttcctctgtcatctctgtcccaggatagcaaacttgtgtatattcagctgttatgggataatatcaaccttcatcaggaaccaagagaacctctgtatgtctcatggaggaattttaattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaaggagtttatacagagaaatcctcttcttatcattagtgtctctaggaagagagaatattgatattgaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggcttggggattagatttcatctggaaacattcaagtttttttttccaaatcgtaagaactggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccgggcacgagagcaacatatttgtgtaagtttgtatatgtgtagggctgtgtaggtatgtgtatatacagccatattctaagtgtatatttattaaaatagattgcatgttgcaatacggttttctgaaaggggtctcattgactattaaataaatgactactactaaacttgtctgtagtcattaatcttaaaattacctgaaaatctgatgacagctgccttccctaactttaatgtattaggttggcacaaaattaattgtagtttttgccactattaatggcaaaaaccgcaattatttttgtaccaacataatacacctttcatattatgtattatcttgcttaatgggttttatcttgattatccagttacttccatcctcttcccaatgttaatttgcaatagttttaaaatgggaacaaatgaatcaatcatcagatagttaaaatgaaattaaatcagctgcctaataatttatggaattcattggaatgtgcttaaaatgctaaagtgtatgtcattgaacatgaaatcttttttcaggcacatacattgttggtattgatgactttttaaaacctgtgggataaacttgcactgcacacggaagttttattcttgtatatttagatttgtatgcttgtgagtaaaaatgtgcatttgtaaatactgtgtttttaggttgaatcaattaagtcttaaaactgtaaatttattaagcttgttgccagtaggtttaagaaaatcatgatctcacatgcctcactttgacatttatcatgccttttattaaaaatatcccttaggaacagtaagtttgccttaactctctgcatggtttaaaaagccattggttttgtgtgtgtttacagtaattatgcagatgactaaatgagttgacacagtaaaattacttccatatggtacagtaacaacctaactcccttctacctgatgtaaccatttacaaattatagttattgtaccagtctttcaacatttcagggttaatctgacctatgcagaattctagtgtgaatttattgtgaaaatgctaaatgaaacaatttgtcagaaattatgtacaattttcattaccttcaaaatggatcttttgcactgtctgagagtatatatttttgcaactcaagacttggtactagttttaatacttaacacttactgacccaacagaagtttggaattaccttgcatataaaaattgaggttgaataaaatgaaaaat

SEQ ID NO: 1856 - DNA, 5740 bp, Homo sapiens
tcagaatcagatgtacctcttttctgccttcctatgggagctactattgagtgctgggatcctgaaaccaaatatccacttccagttttttcaacttttgtcttgacaggttcttcagccaaaaaggtatatggagctgccattcagttttatgaaccttactctcgggaacttctatcagagaaacagcttatgcacctgggcttgttgacgcctgtggagagaaaaatggtctccaaatccatcaatacaaacaaatgcatttgtttactctcacactggcctttttttgaagcttttaggaaatttcttatgtttatctacaaactttctgtgtctggaccacatcctcttcccattgaaaagcacatttcacattttatgcaaaacatcccttttccttcaccacaaagaccgagaatccttgtccagctgtcagtccatgatgcattaatattatcacagccagtttctacacctttaccactaagtggagccaactttagcaccttgctaatgaatctgggtcctgagaattgtgcaacactgctgctctttgttttacttgagagtaaaattctgctgcattctcttaggccagctgtcttgactggggtagctgaagctgttgtagctatgatctttccatttcagtggcaatgcccatatattcccctttgtcctctttcactggctgcagtgcttagtgcacctttaccatttatagttggagttgactcaaggtattttgatcttcatgacccaccacaagatgttgtttgcattgacttggatacgaacatgttatatgtatcagatgaaaagaagaacatgaactggaagcaacttcccaaaaagccgtgcaaaaatctacttagcaccttaaagaaattgtatccccagctgtcttcagttcaccaaaaaactcaagaaggctcagcgattgacatgactccaattgaagcagatttctcctggcaaaagaagatgacacagcttgagatggaaattcaagaggcatttttgcgctttatggcgtctattttaaaaggatatagaacatatctcagaccaatcacagaggctccttcaaataaagccacagctgctgattcattgtttgaccgacagggatttttaaaaagtcgagatcgtgcctatgcaaaattctatacccttttatccaaaacacagatttttattcgtttcattgaagaatgcagttttgtaagtgataaagatactggattagcattttttgatgactgcatagaaaagttgtttcctgataaaggcacagagaaaacagataaggttgattttgattcagcagaagataccagattgatagaactagatgattcacagaaaagtgagcatactgtatttataatgccgccagagccacctcctgatgatggaaaggacctgtcaccaaagtacagttacaaatactttccaagactggaccttaagctttttgacagaccgcaggagttgaaactttgttttagtagacaccctactgggaatagcattacaaagagtccacctctcatggctaagagaactaaacaggaaataaaaacagctcataaattggcgaagagatgttatacaaatccaccacagtgggccaagtgtctgtttagtcattgttacagtttatggtttatttgtcttccggcctatgttagagtttctcatcctaaagtcagagcacttcagcaggcatatgatgtacttattaagatgaggaaaacagatgtggatcccttagatgaggtgtgctatcgagtagtgatgcagctttgtggactttggggtcatcctgttttagcagtgagagtcttatttgaaatgaaaactgctaggataaagcctaatgctattacttatggttattataataaggtagtcttggagagcccgtggcctagcagtacccgcagtggtattttcttatggacgaaggtacggaatgtggtacgtggcttggcacagtttaggcagccgcttaaaaagactgtgcaaaggtcacaggtctcctcaatatcaggtggtcagtctgaccaaggatacgggtctaaggatgaacttataaaggatgatgcagaaattcatgtgcctgaagaacaggcagcaagagaattgataactaaaacaaaaatgcaaacagaagaggtgtgtgatgcctctgctattgtggcaaaacattcacaacctagtccagagcctcacagtcctactgaacctcctgcatggggcagcagtattgtgaaagttccgtctggtatatttgatgtcaacagcaggaaaagtagcactggtagtatatcaaatgtgctgttttctactcaagatccagttgaagatgcagtctttggcgaagctactaatctcaagaagaatggtgatagaggagaaaaaagacaaaagcattttcctgagaggagttgtagttttagttctgaaagtcgagcaggaatgttgcttaagaagagtagtttggattcgaattcaagtgaaatggctatcatgatgggagcagatgccaagattctcacagcagcattgacatgtcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacagcttcctctgtcatctctgtcccaggatagcaaacttgtgtatattcagctgttatgggataatatcaaccttcatcaggaaccaagagaacctctgtatgtctcatggaggaattttaattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaaggagtttatacagagaaatcctcttcttatcattagtgtctctaggaagagagaatattgatattgaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggcttggggattagatttcatctggaaacattcaagtttttttttccaaatcgtaagaactggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccgggcacggtggctcaggcctgtaatcccagcactttgggaggctgagcaaggtgggtggatcacttgaggccaggagttcgagaccagcctggccaacacggtgagaccctgtctttactaaaaatacaaaaattagccaggcgcaccactgtagtcccagctactcaggctgaggcaggagaatcgcttgaactgaggcagaggctacagtgagtggagatcacgccactgcaactccagcttgggtgacagagtgagaccgtctc

SEQ ID NO: 1857 - DNA, 4860 bp, Homo sapiens
tcagaatcagatgtacctcttttctgccttcctatgggagctactattgagtgctgggatcctgaaaccaaatatccacttccagttttttcaacttttgtcttgacaggttcttcagccaaaaaggtatatggagctgccattcagttttatgaaccttactctcgggaacttctatcagagaaacagcttatgcacctgggcttgttgacgcctgtggagagaaaaatggtctccaaatccatcaatacaaacaaatgcatttgtttactctcacactggcctttttttgaagcttttaggaaatttcttatgtttatctacaaactttctgtgtctggaccacatcctcttcccattgaaaagcacatttcacattttatgcaaaacatcccttttccttcaccacaaagaccgagaatccttgtccagctgtcagtccatgatgcattaatattatcacagccagtttctacacctttaccactaagtggagccaactttagcaccttgctaatgaatctgggtcctgagaattgtgcaacactgctgctctttgttttacttgagagtaaaattctgctgcattctcttaggccagctgtcttgactggggtagctgaagctgttgtagctatgatctttccatttcagtggcaatgcccatatattcccctttgtcctctttcactggctgcagtgcttagtgcacctttaccatttatagttggagttgactcaaggtattttgatcttcatgacccaccacaagatgttgtttgcattgacttggatacgaacatgttatatgtatcagatgaaaagaagaacatgaactggaagcaacttcccaaaaagccgtgcaaaaatctacttagcaccttaaagaaattgtatccccagctgtcttcagttcaccaaaaaactcaagaaggctcagcgattgacatgactccaattgaagcagatttctcctggcaaaagaagatgacacagcttgagatggaaattcaagaggcatttttgcgctttatggcgtctattttaaaaggatatagaacatatctcagaccaatcacagaggctccttcaaataaagccacagctgctgattcattgtttgaccgacagggatttttaaaaagtcgagatcgtgcctatgcaaaattctatacccttttatccaaaacacagatttttattcgtttcattgaagaatgcagttttgtaagtgataaagatactggattagcattttttgatgactgcatagaaaagttgtttcctgataaaggcacagagaaaacagataaggttgattttgattcagcagaagataccagattgatagaactagatgattcacagaaaagtgagcatactgtatttataatgccgccagagccacctcctgatgatggaaaggacctgtcaccaaagtacagttacaaatactttccaagactggaccttaagctttttgacagaccgcaggagttgaaactttgttttagtagacaccctactgggaatagcattacaaagagtccacctctcatggctaagagaactaaacaggaaataaaaacagctcataaattggcgaagagatgttatacaaatccaccacagtgggccaagtgtctgtttagtcattgttacagtttatggtttatttgtcttccggcctatgttagagtttctcatcctaaagtcagagcacttcagcaggcatatgatgtacttattaagatgaggaaaacagatgtggatcccttagatgaggtgtgctatcgagtagtgatgcagctttgtggactttggggtcatcctgttttagcagtgagagtcttatttgaaatgaaaactgctaggataaagcctaatgctattacttatggttattataataaggtagtcttggagagcccgtggcctagcagtacccgcagtggtattttcttatggacgaaggtacggaatgtggtacgtggcttggcacagtttaggcagccgcttaaaaagactgtgcaaaggtcacaggtctcctcaatatcaggtggtcagtctgaccaaggatacgggtctaaggatgaacttataaaggatgatgcagaaattcatgtgcctgaagaacaggcagcaagagaattgataactaaaacaaaaatgcaaacagaagaggtgtgtgatgcctctgctattgtggcaaaacattcacaacctagtccagagcctcacagtcctactgaacctcctgcatggggcagcagtattgtgaaagttccgtctggtatatttgatgtcaacagcaggaaaagtagcactggtagtatatcaaatgtgctgttttctactcaagatccagttgaagatgcagtctttggcgaagctactaatctcaagaagaatggtgatagaggagaaaaaagacaaaagcattttcctgagaggagttgtagttttagttctgaaagtcgagcaggaatgttgcttaagaagagtagtttggattcgaattcaagtgaaatggctatcatgatgggagcagatgccaagattctcacagcagcattgacatgtcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacagcttcctctgtcatctctgtcccaggatagcaaacttgtgtatattcagctgttatgggataatatcaaccttcatcaggaaccaagagaacctctgtatgtctcatggaggaattttaattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaagaaatatc

SEQ ID NO: 1858 - DNA, 3767 bp, Homo sapiens
cagaagataccagattgatagaactagatgattcacagaaaagtgagcatactgtatttataatgccgccagagccacctcctgatgatggaaaggacctgtcaccaaagtacagttacaaatactttccaagactggaccttaagctttttgacagaccgcaggagttgaaactttgttttagtagacaccctactgggaatagcattacaaagagtccacctctcatggctaagagaactaaacaggtgtgctatcgagtagtgatgcagctttgtggactttggggtcatcctgttttagcagtgagagtcttatttgaaatgaaaactgctaggataaagcctaatgctattacttatggttattataataaggtagtcttggagagcccgtggcctagcagtacccgcagtggtattttcttatggacgaaggtacggaatgtggtacgtggcttggcacagtttaggcagccgcttaaaaagactgtgcaaaggtcacaggtctcctcaatatcagctcttcaaaatgtcacaggtggaagtgatggggacacggtgagccacggtagtgtggatagttctaatgatgctaacaatggggagcacacagtcttcgtcagagatttaatcaggcttgagtccattgataatcactctagcacagacagacttatatgacgtgaagctatggatacacgtgtgcattaattctacccttgaatgttaaccacatcaggtggtcagtctgaccaaggatacgggtctaaggatgaacttataaaggatgatgcagaaattcatgtgcctgaagaacaggcagcaagagaattgataactaaaacaaaaatgcaaacagaagaggtgtgtgatgcctctgctattgtggcaaaacattcacaacctagtccagagcctcacagtcctactgaacctcctgcatggggcagcagtattgtgaaagttccgtctggtatatttgatgtcaacagcaggaaaagtagcactggtagtatatcaaatgtgctgttttctactcaagatccagttgaagatgcagtctttggcgaagctactaatctcaagaagaatggtgatagaggagaaaaaagacaaaagcattttcctgagaggagttgtagttttagttctgaaagtcgagcaggaatgttgcttaagaagagtagtttggattcgaattcaagtgaaatggctatcatgatgggagcagatgccaagattctcacagcagcattgacatgtcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacagcttcctctgtcatctctgtcccaggatagcaaacttgtgtatattcagctgttatgggataatatcaaccttcatcaggaaccaagagaacctctgtatgtctcatggaggaattttaattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaaggagtttatacagagaaatcctcttcttatcattagtgtctctaggaagagagaatattgatattgaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaa

SEQ ID NO: 1859 - DNA, 5031 bp, Homo sapiens
gaggagggtcacggtgggggctgtccacgcgctctccgcccttctccaggctcgctcgggccgcggcgctctcggctagctgcagcggcggcggcgcggaggggaaggcatccaggatgcggtgcggggcggcccggtgcccccccgccccgtcacggcagccgcggcggccgaggggaccgggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 1860 - DNA, 3593 bp, Homo sapiens
gtgctttttagatctgtggattttttgtttacgtcaaatttgtaaaaattctggccagtatttcttctagtaatttttctgttctccccatccctaccttagggactgcagttacacatacatgtaatatctgggattgcgtagttatcccagaaccgctgatactcttttaatggcaacagttttttctctctctctgtggcttctttgggatcatttctcttgctatggcttcaagctcacttattttttctcctgcattgttgagtgtgcttttaacccagcccgtgtatttttcatctcagatattacagctttcatcttcagaagtttgagttccatgtttctagttttttgttgttgatgttgtttgtttgtttgtttttaagaggttctgctttgttgcccaggctggagtgcggtagtgtaattatagctcaccataaccttaaactcctgggctcaagtgatcttctggccttggcctcctgaatagctaggaataaaggtgtatgccaccatgtctggctcattttttttttttttttgaagagatgaggtctcactatgttgcccaggctggtcttgaagtcctggccttaaatgataccctcactttggcctcccagagtgctgggattacaggcgtaagctatcaggccctggtaatctttgattagatgccagacactgtgaattttactatttgagtcctggacacttccatattcctataaatattctcagtctttgttctgggatgtagttaagttacttagaaataatttgatttctttgtgctttcctctggcaggaccagagcatcctttaggctgtgattaattatctactactgaggcaagaccctctgagtactttactcagtgccccatgagtgattaggttttctagtctggcaggtggggacaggcattattcccagccctgtgtgagcattttgtattgtttctcctaatcctttccggtgattctttctccagccttgagtagtttctttacttgcgtgaactgacccattaccctgctgaatgccctgcagatcccctggattctctctcttctctggtactgttcatatgaactctagccaccttggtctccttaactcagggagtccaccagtctctgcctagaactcccctccctgtgccacagcctggaagctttctctaagcagttagctgggatagttctaggggttacctcatttgttacctgtttctcagggtcctgcccttcattgcctgatgtccagtattctgaagtttatcattttatattattttgcatgggttttttcctattaggcaggaaaatcagtcccttttactctatcttggctggaaatggaagagtagctagattcttaaagaatgtttgacttgatttatttgtgtgtgtatttatgtgtgtgtgtgtgtgtgtgtgtgtgtgtattctcatccagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagttt

SEQ ID NO: 1861 - DNA, 4060 bp, Homo sapiens
ggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatgagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgata

SEQ ID NO: 1862 - DNA, 9310 bp, Homo sapiens
atgggcacccaccaccatgcccagctaatttttgtatttttagtagagatgaggtttcaccatgttgatcaggctggtctcgaactcctgacctcaagcaattcacctgcctcggcctcccgaagtgctgagattacagttgtgagccaacatgcccagccaggatttttgtaccaatggctagaagcagatcgtcatggcaagagccaaggtgctgcaaatacgacttcaggcgaaaattttgaccagagtcctttgagaagaacattcaaatccaaagttctcgcccactatcctcagaatatagaatggaacccttttgatcaagatgcggtgaacatgttgtgcatgcctaaagggctatctttcaggacacaaacggacaataaagacccccagtttcactcatttataattaccagggaagatggttctcgcacctatggttttgttctcactttttatgaagaagttacaagtaagcaaatctgcacagcaatgcagacactttaccagatgcacaacgctgagcattacagcagtgtgtatgcttcatcttcctgcagtatggactcattggcaagtagtcttgatgaaggagatacaacttcccttttgaaactccagcgatacaactcctatgatattagcagagacaccctgtatgtttcaaaaagtatatgcttgatcacaccgttaccattcatgcaggcctgcaagaaattccttatccagctttacaaggctgttacctcacagcagccaccacccttgccacttgaaagctatatccacaatattctttatgaagtaccccttccacctccagggaggtcactgaaattttatggtgtttatgaacctgtcatctgccagaggcctgggcccagtgaactccccctctctgattacccccttcgggaggcatttgagctcctgggattagagaacctggtgcaggtgtttacctgtgttcttttagagatgcaaatccttctctactcacaagattatcaacgcctgatgactgtggcagaaggcatcaccacacttttgttcccatttcaatggcaacatgtttatgtgcccattctacctgcttctctgctacattttcttgatgctcctgtcccttatctgatgggccttcagtcaaaagaaggaactgaccgttctaaactagaacttcctcaagaggctaatttgtgttttgtggacattgacaaccattttattgagttgcctgaagaatttccacagttccccaataaagtggattttatccaagaactctctgaggttcttgttcaatttgggatccctcctgagggcagcctacattgcagtgagagtaccagcaaactgaagaatatggttctgaaagacttggtcaatgacaaaaagaacggcaatgtctgtactaataacatcagcatgtatgagttactgaagggcaatgaaaccatagcccgcttgcaggctctggccaagcgtactggtgtggctgtggaaaaaatggacctctctgcttctctgggtgaaaaagacaaggatttaaaactgcattgtgaagaggcagaactaagggactaccagctcaatgtacagctccgagaggtctttgctaaccgttttacacagatgtttgcagattacgaagcatttgtcattcagactgcccaggacatggaatcctggctgaccaaccgggaacagatgcagaactttgacaaagcttcctttctgtctgaccagcctgagccttacctgccatttctttcacgcttcattgaaacacagatgtttgccacctttattgataataaaattatgtctcagtgggaagagaaagatcctttgcttcgggtctttgacactcggattgataagataaggctgtataatgtaagggcacccaccttgcggacatctatatatcagaaatgcagcactttaaaagaagcagcccaatcaattgagcagagactgatgaaaatggatcacactgcaatccacccacatctacttgatatgaaaattggtcaaggcaaatatgagcaggggttctttccaaagttacagtccgatgtcttggcaacaggaccaaccagtaacaatcgctgggtaagtcggagtgccactgcacagcgcaggaaagaacgccttcgccagcattctgagcatgttgggctggacaacgacttgagggagaaatatatgcaagaggcacgaagtttaggaaaaaacctgaggcaacccaaactgtcagacctctctcctgcagttattgcacagaccaactgtaaattcgtagaaggcttattaaaagaatgtagaatgaagacaaagcgcatgttggtggagaagatgggacatgaagcggtggaacttggccatggagaagcaaacatcaccggcctggaggagaacaccttgatcgccagcctttgtgacctgctggagaggatatggagccatggcttgcaggtcaagcaggggaagtcggctttgtggtcacatttaattcaatttcaggacagagaagagaaacaagagcaccttgcagaatcaccagttgccctcggaccagaaagaagaaaatctgactcaggagttatgttgccaacgctcagggtctctcttattcaggacatgaggcatattcaaaacatgagtgagatcaagactgatgttggacgagctcgggcgtggataagactgtctctagaaaagaagctcttgtcccagcatcttaagcagttgctttctaaccaaccactcaccaagaagctttataagcgatatgcttttctacgttgcgaagaagaaagagagcagtttctttaccaccttctttctctcaatgctgtggactatttctgcttcaccagtgtgttcaccactatcatgattccgtataggtcagtgatcatcccaatcaaaaagctgagcaatgcaataatcacatcaaacccttggatctgtgtatcaggagagctgggagacacaggagtaatgcagattcccaaaaacctcctcgaaatgacctttgagtgccagaacttggggaagctgaccactgttcagattggtcacgataactcaggactgttagccaaatggctagtggattgtgtcatggtcagaaatgaaatcacaggacatacatacagattcccatgtgggcggtggctggggaaaggcattgatgatgggagcctggagagaattcttattggagagttgatgacatcagcatcagatgaagatctagtaaagcagtgtcggactccaccccagcagaagtcacccaccacggctaggagattgagcatcacttcactgacaggaaaaaacaacaaacccaatgctgggcagatacaagaaggaattggagaagctgtgaacaatattgtgaaacattttcataaacctgaaaaagagagaggaagcctcaccgtgttgctgtgtggagaaaatggcctggttgcagcccttgagcaagttttccaccatgggttcaaatctgcccgcatctttcacaagaatgtcttcatctgggacttcatagagaaagtggttgcttattttgaaacaactgaccagattctagataatgaagatgatgtccttattcagaaatcatcctgcaaaaccttctgccactacgtaaatgctattaatactgcacccaggaacattgggaaggatggcaaattccagattttagtttgccttggaacaagggatcgcctgctcccacagtggattccattgttagctgagtgtcctgccatcactcgaatgtatgaagagagcgctctcctgcgagaccgcatgactgtcaactcccttatccgaattctgcagaccattcaggacttcaccatagtcctagaaggatcactcatcaaaggagtggatgtgtaacccaactggctagaaactctcagtccaaaccttgctccttccccaactaggggaccgatttggacttgtctgacagtagtgagtcactgcaggggcagccaaacatatgccccatttggaacaatcctcactctacagacaaggcaaaatgttgtattgtagttcatttgaacctggaatttagtataaaatagagtattttcatgtgttagatgtgtgtaaatatgctatcttctttaagaaattatattactctaataagatgcttttcttagattgaatattcctgtgacttaaaataagtagcttaaaaatgttgggggttggggggaagagtggtgctagccaggaagaagccagtaaacatgtaaatatagtgcaacccagtcgggcttttttttttctccaggtatcacaaagaaacccagaatgcattgttatgtagtagccatccatcttggagtctgatcctttgtattgtggatgcacacagctttacctactgtactggtagtcttcacttctatcttttaagttacaaactgttttatatatttgaatcgctagtcacttttccagtcttttggaaaaaaatttcagtccgcacaagatgatataattggagtattttaaacactagaccccaggagcttggctgaactggaaagagaacatacaaagctctgagaaatgtgttcaattgtgggattataacttctttacacttcggaaagattagcctagactaacttcattcttggcatttttattcttgttatttgaggtactttgggaagatgtgaatttcagtgttagattcatagtgataagaactgcaaacagcaatttgattctgtacttttaatttggccatctaaactgtgcagtggtctacctcttaaggataaccatgagccctgtctttgttagggtctaatcacccacctctccagggcccatcccccctcgggaaatggaaggaatgtctaaggaggaggagggctgtgtgtggcttggaatgtttttgtgaaagcatttgttgaccatgataatgcaaataacagaaggagagagagaatgaaccctttctgggtgtttcagggcaagctttacgttcctttgtaggaaggggagtaataatgtaaaacaactgacccagagaagctaaaagccactggcagcacaggctgacaaaatggaagcaaagcaagaggtggcaacaattttgaaagaccaaaagttgtgagtaactttccagtttgatagtttataaagaagttaagtaaatgtagtattggctagttactgtaagtcctcatcttctggtaggtcctgtaactctaattaggcatttgtacatttttagcagcaaaattgcctcagcagagctcccagttttattcccagttgtggctgaaaagcaaagccatggcatcagtatccttgtgcaatcggaggttgctgggctttcaccacctgtgttgttaaccttatttcctggaggaagaaacagatgaaacaagtgcctaactccctttatcaaacacagccaaggacagcctcttttaacatgtgacttcatacttgaggaaaaggagagttgacagctgtatttaaaaacccatggagccgggtgcggtggctcacgcctatgatcccagcactttgggaggccgaggcaggcggatcacaaggtcaggagattgagaccctcctggctaacaccgtgaaaccccgtctctactaaaaatacaaaaaattagccgggcgtggtggcgggtgcctgtacaggaggctgaggcaggagaatggcgtgaacccgcgaggcggagcttgcagtaagctgagatcgcgccactgccctccagcctgggcaacagagcaagactccatctcaaaaaataaatagataaaaataaaaacccatggaaatggtttaagaaaatggttctgggtacaccagaaatttgtttgcctgaagctaaagtgtgtctacaatggtacagctcttccagggacatgggaagtttatcgtgggagatatccagaacctgttttacactgggctcctactgtgtttggtgatcagaaactatagaggggtccaacccaggatttcatgtttgtatcttcataaggccatgctcctgacaggtctaggcaacctgggggatgacttaggttaatgtgctaggattgacacacctcatccagccttcttactttgtggatgggaacacttaaggaatagagagattaaatcttacacttaccccacagctggttactgacaacacaagctctagaattcatgtttgtttgtttgttttatttcaccaggctgcatgagactgaccttccggcattcttactaatagtctttctattatactattggatctttattcatccacctatacaagtaggaaataaggatgaatattcatttagaagaattaatattcatattaacacattgctctcagattattgggaattaacatcttgtaaaaactgggagcaggccaggtacggtggctaacgcctgtaatcctgacactttgggagtctgaggcgggtggttcatctgaggtcagtcgggagttcaagaccagactggccaacatggtgaaaccccgtctctactaaaaaaaaaaaatagacaaaaattagcgggggggtggtggcagggcctgtaattccagctactcaggaggctgaagcaggagaatcgtttaaacacaggaggtggaggttgcagtgagccgagattgtgccactgcactccaacctgggtgacaagagcgagactccgtctcaaaaaaaaaaaaagaaaaaaactgcagccaaagttggatttgcggcctatgaataaaaccattactttaaaaagtaatacccccaaaaaagttacacctgaagtttcatcttcatgcctttgtgtaatattactataatggtgaaatgatgatttaaaaaaaacacatcagaactgacacatcctcttggatgatgggtccttcagtcaccttgtgagcccatgtacttattccgttgatacagcctgtgctataaacatgtggggccctccttgtgtgagctgcttgaatggccagtacccccattcttttgaatattcccaatggcagtcaatcttggcctttaagaataaatttaaatatttggaaatagtccttaggatccaagtttgatcaatgaaaaggatgcttaagctgagtttggggtcacataagaagtgcagttataaagaaataagacatgttgggcatggcagtacacacctgtagtcccagctgcttgggaagccaaggcaggaggatcacttcaacccaggagtttgagtccagcctgggtaacatagggaaaccccatctcaaaaaaacaaaacaaaggacttagtttttatgtggctcataagtgtctctaagttataccaaaagtttgagcacaacagtagtagcagaatgcttagaataaatgcttgacttttaagctgacttttggaaggaccatacccacatagaggcatcttttctgctgtggtaattttttaaattaatacattgctttaggattacatctcaaagtaaataaaaaaatcaatatttaatttgtttttttcctgcaaataaattaaatgctgggaccataatgattatttttgcatagtaatagctggtgaagaagttgttttaaaattaaattgccaaaagtattacctcttgaaaaatttattttcccaaagtttttcatatgtcatgaaacccctaatcttgacctttatgacacagtggcattacactgatgttggaagcatgtgtgagatctgtgccctggtcgggagtcatatgccttaaaaatgactgcgagtcagtgtgaagtagtataaagtggagtcctacgtgggaaaaagcaggctactgaggacaaaaacctcccaaccctccccaccttgttttccactgggaatgagaatttgatatgagaaacttcaaccttgcagaagtgtggatttccctctgaaatttaaatgtttcacacatttttgtaccttttgtaaccttgtggtatttactttcacatggctttttaaaaaattattttaatgaacttctatcacactatatgaatgatatgggggaaatactgaactgctcatatttccttttttggcaataaagcactgttatatgtaaatgtaagtgaaaaagaggttcaagactatacaacagcttatgtgtagtatatgttgacatccctaaggtattttgaaacatgaggtgacagacaaggacctcaaatttccagggaaatatttatttcacaacattaggagtgtagctcttcataatgaaatatcttctttctgctaaagattacaatttttcatttagggaactgtgaatattttctgtgaggtttacagaaactagtgtatccttttcactatgttgaaaagacaatctgaactttagctatttatatttcagtattaacacaccttcactgattgagagtcttgagcccttctctacttttataaagtgaatcctatttccaagtcatccatgtcttttgaagtctgtttcttatataagtatttattactttactgtttagcataaataggagacagaaaaggataataaactactaggtcctttattcctattaaaataaatttataaatcccttgaatcaactgaattctaagctttttgaagaggttgctgatgtagtgtgatcaaaagaatctaaggagaacctcctctccaaaatctgattggagctgttcaccctctcaaggacaagataaagattgacttcagagatatatcacatcaagctagaggaaaaaaaaaaaacctcaaataaaatttttcctcattcgaagggatccagggtatccttgggttatgtaggagggaatcatatttgttctaatttacctgaatgtacttgtgtgtgaatccaatcttgattctaaacaccaaatcttgtcaacagtagagaagtatagtaaggagttcctgttgtcaatcaaatgagggtgtgaaacatttagaatgctctgtgttacacttgaaccatgtataaatgtaacctgtgtatcttttttttaattagcttttctgaatttaaattatattgtttttctttgtattgttagcaaaatgcatcagaactggattttttttctcatctgaacataatataaaatttgaaagagtattgtgatattaagcactttaacatacatatcagacaaactgacgtgggtttttcaggtttgggagtacatttaaatatgacttttcatgctttgttctttacaaataaaactgtgggattgatactt

SEQ ID NO: 1863 - DNA, 3132 bp, Homo sapiens
gcttcccccgcgccgagcgaggaggcaggctgcggcggcgagaggcggctgcgcggccatgggcgcgccagtgtcgccctagggcgggcgcacagaccacagccggagcggtggtggcagcctccgcagaaagccttcccgggcggcggcggcggcggcccctggagcagcgcggccgggatgagcgggagctgcgcggcgcccggcccgggctcgggctcctccccggccgcctgccgcttcgcgcactacttcgtgctgtgcgggatcgacgcggacagcgggctggagcctgacgagctggcggttttgtaccaatggctagaagcagatcgtcatggcaagagccaaggtgctgcaaatacgacttcaggcgaaaattttgaccagagtcctttgagaagaacattcaaatccaaagttctcgcccactatcctcagaatatagaatggaacccttttgatcaagatgcggtgaacatgttgtgcatgcctaaagggctatctttcaggacacaaacggacaataaagacccccagtttcactcatttataattaccagggaagatggttctcgcacctatggttttgttctcactttttatgaagaagttacaagtaagcaaatctgcacagcaatgcagacactttaccagatgcacaacgctgagcattacagcagtgtgtatgcttcatcttcctgcagtatggactcattggcaagtagtcttgatgaaggagatacaacttcccttttgaaactccagcgatacaactcctatgatattagcagagacaccctgtatgtttcaaaaagtatatgcttgatcacaccgttaccattcatgcaggcctgcaagaaattccttatccagctttacaaggctgttacctcacagcagccaccacccttgccacttgaaagctatatccacaatattctttatgaagtaccccttccacctccagggaggtcactgaaattttatggtgtttatgaacctgtcatctgccagaggcctgggcccagtgaactccccctctctgattacccccttcgggaggcatttgagctcctgggattagagaacctggtgcaggtgtttacctgtgttcttttagagatgcaaatccttctctactcacaagattatcaacgcctgatgactgtggcagaaggcatcaccacacttttgttcccatttcaatggcaacatgtttatgtgcccattctacctgcttctctgctacattttcttgatgctcctgtcccttatctgatgggccttcagtcaaaagaaggaactgaccgttctaaactagaacttcctcaagaggctaatttgtgttttgtggacattgacaaccattttattgagttgcctgaagaatttccacagttccccaataaagtggattttatccaagaactctctgaggttcttgttcaatttgggatccctcctgagggcagcctacattgcagtgagagtaccagcaaactgaagaatatggttctgaaagacttggtcaatgacaaaaagaacggcaatgtctgtactaataacatcagcatgtatgagttactgaagggcaatgaaaccatagcccgcttgcaggctctggccaagcgtactggtgtggctgtggaaaaaatggacctctctgcttctctgggtgaaaaagacaaggatttaaaactgcattgtgaagaggcagaactaagggactaccagctcaatgtacagctccgagaggtctttgctaaccgttttacacagatgtttgcagattacgaagcatttgtcattcagactgcccaggacatggaatcctggctgaccaaccgggaacagatgcagaactttgacaaagcttcctttctgtctgaccagcctgagccttacctgccatttctttcacgcttcattgaaacacagatgtttgccacctttattgataataaaattatgtctcagtgggaagagaaagatcctttgcttcgggtctttgacactcggattgataagataaggctgtataatgtaagggcacccaccttgcggacatctatatatcagaaatgcagcactttaaaagaagcagcccaatcaattgagcagagactgatgaaaatggatcacactgcaatccacccacatctacttgatatgaaaattggtcaaggcaaatatgagcaggggttctttccaaagttacagtccgatgtcttggcaacaggaccaaccagtaacaatcgctgggtaagtcggagtgccactgcacagcgcaggaaagaacgccttcgccagcattctgagcatgttgggctggacaacgacttgagggaggtatgtggtctaccttcctggggtgcctcacagcaagcgccatgaactaggcttattccttccagcagatgtcattgtgtagattcttaatgttctttaaaaaaaaaactgtttagttatagtttaaaatattaatccttttgtacggacatatagcagaaaacacccttttttccatttttgtaatttcaagacatctataataaggctctaaaacaagtctttctgtgtattacatcaagtaaagatcaagttgaggataaatttttagttactatgtctcctataggagaaaaattgtctgcatgagaagcctagacatttctaagtttcaagcataattataaggagtagtgtgatgtacttgcctatgctttgttcttggcttgctggcaccagttttttttcttgaatctctaaatctactttatatttttgaaagtgttttaaaactatttttaaattaagatccttacacttttatttgtactctttgaaaataagaccataattatacaacaagtaagttttgatttttttctgtgtgaaatctgcatatatatatagtgtcttgctatgttgcccaggtcttgaactcctgggctcaagcagtgctcctgcctcagcctcccaaagtattgggattacaggtgtgagctgccatgcccagcctgattgtttcgtttcttatgatcaaaagagaaatgcaatcagaagacttgttaactgttttctagtatcaaatttgtaaaaataaagcagaaaacatcatcccaaaca

SEQ ID NO: 1864 - DNA, 9470 bp, Homo sapiens
gcgagggcctctcaggccgacactccccccgcgcccctcccccacccggccgggctccggacccgccgcgcgcgagcccgcggccgcttcccccgcgccgagcgaggaggcaggctgcggcggcgagaggcggctgcgcggccatgggcgcgccagtgtcgccctagggcgggcgcacagaccacagccggagcggtggtggcagcctccgcagaaagccttcccgggcggcggcggcggcggcccctggagcagcgcggccgggatgagcgggagctgcgcggcgcccggcccgggctcgggctcctccccggccgcctgccgcttcgcgcactacttcgtgctgtgcgggatcgacgcggacagcgggctggagcctgacgagctggcgggcgaaaattttgaccagagtcctttgagaagaacattcaaatccaaagttctcgcccactatcctcagaatatagaatggaacccttttgatcaagatgcggtgaacatgttgtgcatgcctaaagggctatctttcaggacacaaacggacaataaagacccccagtttcactcatttataattaccagggaagatggttctcgcacctatggttttgttctcactttttatgaagaagttacaagtaagcaaatctgcacagcaatgcagacactttaccagatgcacaacgctgagcattacagcagtgtgtatgcttcatcttcctgcagtatggactcattggcaagtagtcttgatgaaggagatacaacttcccttttgaaactccagcgatacaactcctatgatattagcagagacaccctgtatgtttcaaaaagtatatgcttgatcacaccgttaccattcatgcaggcctgcaagaaattccttatccagctttacaaggctgttacctcacagcagccaccacccttgccacttgaaagctatatccacaatattctttatgaagtaccccttccacctccagggaggtcactgaaattttatggtgtttatgaacctgtcatctgccagaggcctgggcccagtgaactccccctctctgattacccccttcgggaggcatttgagctcctgggattagagaacctggtgcaggtgtttacctgtgttcttttagagatgcaaatccttctctactcacaagattatcaacgcctgatgactgtggcagaaggcatcaccacacttttgttcccatttcaatggcaacatgtttatgtgcccattctacctgcttctctgctacattttcttgatgctcctgtcccttatctgatgggccttcagtcaaaagaaggaactgaccgttctaaactagaacttcctcaagaggctaatttgtgttttgtggacattgacaaccattttattgagttgcctgaagaatttccacagttccccaataaagtggattttatccaagaactctctgaggttcttgttcaatttgggatccctcctgagggcagcctacattgcagtgagagtaccagcaaactgaagaatatggttctgaaagacttggtcaatgacaaaaagaacggcaatgtctgtactaataacatcagcatgtatgagttactgaagggcaatgaaaccatagcccgcttgcaggctctggccaagcgtactggtgtggctgtggaaaaaatggacctctctgcttctctgggtgaaaaagacaaggatttaaaactgcattgtgaagaggcagaactaagggactaccagctcaatgtacagctccgagaggtctttgctaaccgttttacacagatgtttgcagattacgaagcatttgtcattcagactgcccaggacatggaatcctggctgaccaaccgggaacagatgcagaactttgacaaagcttcctttctgtctgaccagcctgagccttacctgccatttctttcacgcttcattgaaacacagatgtttgccacctttattgataataaaattatgtctcagtgggaagagaaagatcctttgcttcgggtctttgacactcggattgataagataaggctgtataatgtaagggcacccaccttgcggacatctatatatcagaaatgcagcactttaaaagaagcagcccaatcaattgagcagagactgatgaaaatggatcacactgcaatccacccacatctacttgatatgaaaattggtcaaggcaaatatgagcaggggttctttccaaagttacagtccgatgtcttggcaacaggaccaaccagtaacaatcgctgggtaagtcggagtgccactgcacagcgcaggaaagaacgccttcgccagcattctgagcatgttgggctggacaacgacttgagggagaaatatatgcaagaggcacgaagtttaggaaaaaacctgaggcaacccaaactgtcagacctctctcctgcagttattgcacagaccaactgtaaattcgtagaaggcttattaaaagaatgtagaatgaagacaaagcgcatgttggtggagaagatgggacatgaagcggtggaacttggccatggagaagcaaacatcaccggcctggaggagaacaccttgatcgccagcctttgtgacctgctggagaggatatggagccatggcttgcaggtcaagcaggggaagtcggctttgtggtcacatttaattcaatttcaggacagagaagagaaacaagagcaccttgcagaatcaccagttgccctcggaccagaaagaagaaaatctgactcaggagttatgttgccaacgctcagggtctctcttattcaggacatgaggcatattcaaaacatgagtgagatcaagactgatgttggacgagctcgggcgtggataagactgtctctagaaaagaagctcttgtcccagcatcttaagcagttgctttctaaccaaccactcaccaagaagctttataagcgatatgcttttctacgttgcgaagaagaaagagagcagtttctttaccaccttctttctctcaatgctgtggactatttctgcttcaccagtgtgttcaccactatcatgattccgtataggtcagtgatcatcccaatcaaaaagctgagcaatgcaataatcacatcaaacccttggatctgtgtatcaggagagctgggagacacaggagtaatgcagattcccaaaaacctcctcgaaatgacctttgagtgccagaacttggggaagctgaccactgttcagattggtcacgataactcaggactgttagccaaatggctagtggattgtgtcatggtcagaaatgaaatcacaggacatacatacagattcccatgtgggcggtggctggggaaaggcattgatgatgggagcctggagagaattcttattggagagttgatgacatcagcatcagatgaagatctagtaaagcagtgtcggactccaccccagcagaagtcacccaccacggctaggagattgagcatcacttcactgacaggaaaaaacaacaaacccaatgctgggcagatacaagaaggaattggagaagctgtgaacaatattgtgaaacattttcataaacctgaaaaagagagaggaagcctcaccgtgttgctgtgtggagaaaatggcctggttgcagcccttgagcaagttttccaccatgggttcaaatctgcccgcatctttcacaagaatgtcttcatctgggacttcatagagaaagtggttgcttattttgaaacaactgaccagattctagataatgaagatgatgtccttattcagaaatcatcctgcaaaaccttctgccactacgtaaatgctattaatactgcacccaggaacattgggaaggatggcaaattccagattttagtttgccttggaacaagggatcgcctgctcccacagtggattccattgttagctgagtgtcctgccatcactcgaatgtatgaagagagcgctctcctgcgagaccgcatgactgtcaactcccttatccgaattctgcagaccattcaggacttcaccatagtcctagaaggatcactcatcaaaggagtggatgtgtaacccaactggctagaaactctcagtccaaaccttgctccttccccaactaggggaccgatttggacttgtctgacagtagtgagtcactgcaggggcagccaaacatatgccccatttggaacaatcctcactctacagacaaggcaaaatgttgtattgtagttcatttgaacctggaatttagtataaaatagagtattttcatgtgttagatgtgtgtaaatatgctatcttctttaagaaattatattactctaataagatgcttttcttagattgaatattcctgtgacttaaaataagtagcttaaaaatgttgggggttggggggaagagtggtgctagccaggaagaagccagtaaacatgtaaatatagtgcaacccagtcgggcttttttttttctccaggtatcacaaagaaacccagaatgcattgttatgtagtagccatccatcttggagtctgatcctttgtattgtggatgcacacagctttacctactgtactggtagtcttcacttctatcttttaagttacaaactgttttatatatttgaatcgctagtcacttttccagtcttttggaaaaaaatttcagtccgcacaagatgatataattggagtattttaaacactagaccccaggagcttggctgaactggaaagagaacatacaaagctctgagaaatgtgttcaattgtgggattataacttctttacacttcggaaagattagcctagactaacttcattcttggcatttttattcttgttatttgaggtactttgggaagatgtgaatttcagtgttagattcatagtgataagaactgcaaacagcaatttgattctgtacttttaatttggccatctaaactgtgcagtggtctacctcttaaggataaccatgagccctgtctttgttagggtctaatcacccacctctccagggcccatcccccctcgggaaatggaaggaatgtctaaggaggaggagggctgtgtgtggcttggaatgtttttgtgaaagcatttgttgaccatgataatgcaaataacagaaggagagagagaatgaaccctttctgggtgtttcagggcaagctttacgttcctttgtaggaaggggagtaataatgtaaaacaactgacccagagaagctaaaagccactggcagcacaggctgacaaaatggaagcaaagcaagaggtggcaacaattttgaaagaccaaaagttgtgagtaactttccagtttgatagtttataaagaagttaagtaaatgtagtattggctagttactgtaagtcctcatcttctggtaggtcctgtaactctaattaggcatttgtacatttttagcagcaaaattgcctcagcagagctcccagttttattcccagttgtggctgaaaagcaaagccatggcatcagtatccttgtgcaatcggaggttgctgggctttcaccacctgtgttgttaaccttatttcctggaggaagaaacagatgaaacaagtgcctaactccctttatcaaacacagccaaggacagcctcttttaacatgtgacttcatacttgaggaaaaggagagttgacagctgtatttaaaaacccatggagccgggtgcggtggctcacgcctatgatcccagcactttgggaggccgaggcaggcggatcacaaggtcaggagattgagaccctcctggctaacaccgtgaaaccccgtctctactaaaaatacaaaaaattagccgggcgtggtggcgggtgcctgtacaggaggctgaggcaggagaatggcgtgaacccgcgaggcggagcttgcagtaagctgagatcgcgccactgccctccagcctgggcaacagagcaagactccatctcaaaaaataaatagataaaaataaaaacccatggaaatggtttaagaaaatggttctgggtacaccagaaatttgtttgcctgaagctaaagtgtgtctacaatggtacagctcttccagggacatgggaagtttatcgtgggagatatccagaacctgttttacactgggctcctactgtgtttggtgatcagaaactatagaggggtccaacccaggatttcatgtttgtatcttcataaggccatgctcctgacaggtctaggcaacctgggggatgacttaggttaatgtgctaggattgacacacctcatccagccttcttactttgtggatgggaacacttaaggaatagagagattaaatcttacacttaccccacagctggttactgacaacacaagctctagaattcatgtttgtttgtttgttttatttcaccaggctgcatgagactgaccttccggcattcttactaatagtctttctattatactattggatctttattcatccacctatacaagtaggaaataaggatgaatattcatttagaagaattaatattcatattaacacattgctctcagattattgggaattaacatcttgtaaaaactgggagcaggccaggtacggtggctaacgcctgtaatcctgacactttgggagtctgaggcgggtggttcatctgaggtcagtcgggagttcaagaccagactggccaacatggtgaaaccccgtctctactaaaaaaaaaaaatagacaaaaattagcgggggggtggtggcagggcctgtaattccagctactcaggaggctgaagcaggagaatcgtttaaacacaggaggtggaggttgcagtgagccgagattgtgccactgcactccaacctgggtgacaagagcgagactccgtctcaaaaaaaaaaaaagaaaaaaactgcagccaaagttggatttgcggcctatgaataaaaccattactttaaaaagtaatacccccaaaaaagttacacctgaagtttcatcttcatgcctttgtgtaatattactataatggtgaaatgatgatttaaaaaaaacacatcagaactgacacatcctcttggatgatgggtccttcagtcaccttgtgagcccatgtacttattccgttgatacagcctgtgctataaacatgtggggccctccttgtgtgagctgcttgaatggccagtacccccattcttttgaatattcccaatggcagtcaatcttggcctttaagaataaatttaaatatttggaaatagtccttaggatccaagtttgatcaatgaaaaggatgcttaagctgagtttggggtcacataagaagtgcagttataaagaaataagacatgttgggcatggcagtacacacctgtagtcccagctgcttgggaagccaaggcaggaggatcacttcaacccaggagtttgagtccagcctgggtaacatagggaaaccccatctcaaaaaaacaaaacaaaggacttagtttttatgtggctcataagtgtctctaagttataccaaaagtttgagcacaacagtagtagcagaatgcttagaataaatgcttgacttttaagctgacttttggaaggaccatacccacatagaggcatcttttctgctgtggtaattttttaaattaatacattgctttaggattacatctcaaagtaaataaaaaaatcaatatttaatttgtttttttcctgcaaataaattaaatgctgggaccataatgattatttttgcatagtaatagctggtgaagaagttgttttaaaattaaattgccaaaagtattacctcttgaaaaatttattttcccaaagtttttcatatgtcatgaaacccctaatcttgacctttatgacacagtggcattacactgatgttggaagcatgtgtgagatctgtgccctggtcgggagtcatatgccttaaaaatgactgcgagtcagtgtgaagtagtataaagtggagtcctacgtgggaaaaagcaggctactgaggacaaaaacctcccaaccctccccaccttgttttccactgggaatgagaatttgatatgagaaacttcaaccttgcagaagtgtggatttccctctgaaatttaaatgtttcacacatttttgtaccttttgtaaccttgtggtatttactttcacatggctttttaaaaaattattttaatgaacttctatcacactatatgaatgatatgggggaaatactgaactgctcatatttccttttttggcaataaagcactgttatatgtaaatgtaagtgaaaaagaggttcaagactatacaacagcttatgtgtagtatatgttgacatccctaaggtattttgaaacatgaggtgacagacaaggacctcaaatttccagggaaatatttatttcacaacattaggagtgtagctcttcataatgaaatatcttctttctgctaaagattacaatttttcatttagggaactgtgaatattttctgtgaggtttacagaaactagtgtatccttttcactatgttgaaaagacaatctgaactttagctatttatatttcagtattaacacaccttcactgattgagagtcttgagcccttctctacttttataaagtgaatcctatttccaagtcatccatgtcttttgaagtctgtttcttatataagtatttattactttactgtttagcataaataggagacagaaaaggataataaactactaggtcctttattcctattaaaataaatttataaatcccttgaatcaactgaattctaagctttttgaagaggttgctgatgtagtgtgatcaaaagaatctaaggagaacctcctctccaaaatctgattggagctgttcaccctctcaaggacaagataaagattgacttcagagatatatcacatcaagctagaggaaaaaaaaaaaacctcaaataaaatttttcctcattcgaagggatccagggtatccttgggttatgtaggagggaatcatatttgttctaatttacctgaatgtacttgtgtgtgaatccaatcttgattctaaacaccaaatcttgtcaacagtagagaagtatagtaaggagttcctgttgtcaatcaaatgagggtgtgaaacatttagaatgctctgtgttacacttgaaccatgtataaatgtaacctgtgtatcttttttttaattagcttttctgaatttaaattatattgtttttctttgtattgttagcaaaatgcatcagaactggattttttttctcatctgaacataatataaaatttgaaagagtattgtgatattaagcactttaacatacatatcagacaaactgacgtgggtttttcaggtttgggagtacatttaaatatgacttttcatgctttgttctttacaaataaaactgtgggattgatactt

SEQ ID NO: 1865 - DNA, 4291 bp, Homo sapiens
acggaccccgcctggcgcgccggccccttcgcttgcagccgcactcggaggcggccggctgaagtgcagtggcatgatctcagatcactacaacctccacctcttgggttccagtaattctcctgcctggccttcctgagtaactgggattatgggcacccaccaccatgcccagctaatttttgtatttttagtagagatgaggtttcaccatgttgatcaggctggtctcgaactcctgacctcaagcaattcacctgcctcggcctcccgaagtgctgagattacagttgtgagccaacatgcccagccaggatttttgtaccaatggctagaagcagatcgtcatggcaagagccaaggtgctgcaaatacgacttcaggcgaaaattttgaccagagtcctttgagaagaacattcaaatccaaagttctcgcccactatcctcagaatatagaatggaacccttttgatcaagatgcggtgaacatgttgtgcatgcctaaagggctatctttcaggacacaaacggacaataaagacccccagtttcactcatttataattaccagggaagatggttctcgcacctatggttttgttctcactttttatgaagaagttacaagtaagcaaatctgcacagcaatgcagacactttaccagatgcacaacgctgagcattacagcagtgtgtatgcttcatcttcctgcagtatggactcattggcaagtagtcttgatgaaggagatacaacttcccttttgaaactccagcgatacaactcctatgatattagcagagacaccctgtatgtttcaaaaagtatatgcttgatcacaccgttaccattcatgcaggcctgcaagaaattccttatccagctttacaaggctgttacctcacagcagccaccacccttgccacttgaaagctatatccacaatattctttatgaagtaccccttccacctccagggaggtcactgaaattttatggtgtttatgaacctgtcatctgccagaggcctgggcccagtgaactccccctctctgattacccccttcgggaggcatttgagctcctgggattagagaacctggtgcaggtgtttacctgtgttcttttagagatgcaaatccttctctactcacaagattatcaacgcctgatgactgtggcagaaggcatcaccacacttttgttcccatttcaatggcaacatgtttatgtgcccattctacctgcttctctgctacattttcttgatgctcctgtcccttatctgatgggccttcagtcaaaagaaggaactgaccgttctaaactagaacttcctcaagaggctaatttgtgttttgtggacattgacaaccattttattgagttgcctgaagaatttccacagttccccaataaagtggattttatccaagaactctctgaggttcttgttcaatttgggatccctcctgagggcagcctacattgcagtgagagtaccagcaaactgaagaatatggttctgaaagacttggtcaatgacaaaaagaacggcaatgtctgtactaataacatcagcatgtatgagttactgaagggcaatgaaaccatagcccgcttgcaggctctggccaagcgtactggtgtggctgtggaaaaaatggacctctctgcttctctgggtgaaaaagacaaggatttaaaactgcattgtgaagaggcagaactaagggactaccagctcaatgtacagctccgagaggtctttgctaaccgttttacacagatgtttgcagattacgaagcatttgtcattcagactgcccaggacatggaatcctggctgaccaaccgggaacagatgcagaactttgacaaagcttcctttctgtctgaccagcctgagccttacctgccatttctttcacgcttcattgaaacacagatgtttgccacctttattgataataaaattatgtctcagtgggaagagaaagatcctttgcttcgggtctttgacactcggattgataagataaggctgtataatgtaagggcacccaccttgcggacatctatatatcagaaatgcagcactttaaaagaagcagcccaatcaattgagcagagactgatgaaaatggatcacactgcaatccacccacatctacttgatatgaaaattggtcaaggcaaatatgagcaggggttctttccaaagttacagtccgatgtcttggcaacaggaccaaccagtaacaatcgctgggtaagtcggagtgccactgcacagcgcaggaaagaacgccttcgccagcattctgagcatgttgggctggacaacgacttgagggagaaatatatgcaagaggcacgaagtttaggaaaaaacctgaggcaacccaaactgtcagacctctctcctgcagttattgcacagaccaactgtaaattcgtagaaggcttattaaaagaatgtagaatgaagacaaagcgcatgttggtggagaagatgggacatgaagcggtggaacttggccatggagaagcaaacatcaccggcctggaggagaacaccttgatcgccagcctttgtgacctgctggagaggatatggagccatggcttgcaggtcaagcaggggaagtcggctttgtggtcacatttaattcaatttcaggacagagaagagaaacaagagcaccttgcagaatcaccagttgccctcggaccagaaagaagaaaatctgactcaggagttatgttgccaacgctcagggtctctcttattcaggacatgaggcatattcaaaacatgagtgagatcaagactgatgttggacgagctcgggcgtggataagactgtctctagaaaagaagctcttgtcccagcatcttaagcagttgctttctaaccaaccactcaccaagaagctttataagcgatatgcttttctacgttgcgaagaagaaagagagcagtttctttaccaccttctttctctcaatgctgtggactatttctgcttcaccagtgtgttcaccactatcatgattccgtataggtcagtgatcatcccaatcaaaaagctgagcaatgcaataatcacatcaaacccttggatctgtgtatcaggagagctgggagacacaggagtaatgcagattcccaaaaacctcctcgaaatgacctttgagtgccagaacttggggaagctgaccactgttcagattggtcacgataactcaggactgttagccaaatggctagtggattgtgtcatggtcagaaatgaaatcacaggacatacatacagattcccatgtgggcggtggctggggaaaggcattgatgatgggagcctggagagaattcttattggagagttgatgacatcagcatcagatgaagatctagtaaagcagtgtcggactccaccccagcagaagtcacccaccacggctaggagattgagcatcacttcactgacaggaaaaaacaacaaacccaatgctgggcagatacaagaaggaattggagaagctgtgaacaatattgtgaaacattttcataaacctgaaaaagagagaggaagcctcaccgtgttgctgtgtggagaaaatggcctggttgcagcccttgagcaagttttccaccatgggttcaaatctgcccgcatctttcacaagaatgtcttcatctgggacttcatagagaaagtggttgcttattttgaaacaactgaccagattctagataatgaagatgatgtccttattcagaaatcatcctgcaaaaccttctgccactacgtaaatgctattaatactgcacccaggaacattgggaaggatggcaaattccagattttagtttgccttggaacaagggatcgcctgctcccacagtggattccattgttagctgagtgtcctgccatcactcgaatgtatgaagagagcgctctcctgcgagaccgcatgactgtcaactcccttatccgaattctgcagaccattcaggacttcaccatagtcctagaaggatcactcatcaaaggagtggatgtgtaacccaactggctagaaactctcagtccaaaccttgctccttccccaactaggggaccgatttggacttgtctgacagtagtgagtcactgcaggggcagccaaacatatgccccatttggaacaatcctcactctacagacaaggcaaaatgttgtattgtagttcatttgaacctggaatttagtataaaatagagtattttcatgtgtt

SEQ ID NO: 1866 - DNA, 731 bp, Homo sapiens
ggccacgctttgaggaaagaaggggcgcaaggttggtgggaccgacccttgggaaccgggcggccgcctggcatgatgggagttgtagttcgatgctggtttagggtttcaggcgtggaggttccaaaatccgaggtttgatttcagcctgcccttgccagtgcctgggccgctgggagccgttattggctgccgttaaggaccgttacgtttcccgggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccgggagccccgtaccagccccagaggaaagaagcacgttccctcagctcttaaggaggctgacagtttaatgagaagagacacatga

SEQ ID NO: 1867 - DNA, 2119 bp, Homo sapiens
ggccacgctttgaggaaagaaggggcgcaaggttggtgggaccgacccttgggaaccgggcggccgcctggcatgatgggagttgtagttcgatgctggtttagggtttcaggcgtggaggttccaaaatccgaggtttgatttcagcctgcccttgccagtgcctgggccgctgggagccgttattggctgccgttaaggaccgttacgtttcccgggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccggggataccgctacgtgattctggatatccccctgctgtttgagaccaagaagttgctcaagtacatgaagcacaccgtggtagtatactgcgaccgggacacacagctggcacggctgatgcggcggaacagcctgaaccgcaaggacgcagaggcccgcatcaatgcccagctgcccctgacagacaaggcccgcatggcccgccatgtcctagacaactcgggcgagtggagtgtcaccaaacgccaggtcatcctcttgcacactgagctggagcgctccctggagtacctgccgctgaggtttggggtcctcacagggctcgctgccattgccagcctcctctacctgctcacccactaccttctgccttacgcctagtggggcactcaaggcagggagccccaggcctccatctatctccttggaggctgaagccaggtaacacatcctgtttcctctcagccccctccccacacacacacacacacacacacacacacacacacacacacacacacacacacggactctccgaatcagggctgggcctctgtgccaggccatcccgtctttggagtgtatcctatttgagatcaagaaatagcctgctgtccttcccaccttccctgagcagcacctacagaacagcaaccgtgatggtgtgtgaaagcaacagtcagagactgctatacatttctgtgggtgggggtagggaatactggctctgtggccctcctcagagctgggaggccaagggttcactgggcttgaatcctctctaagcacctaccccattgtggcctaaacctcctcagtggaccacgggaaatcatgttggaccaagggtttccatgttcaaacagtcaacaaggccctcccctaggttgagatattttttatactgaaggcccaggccccccagtatggcttgctgccagcaagcagcaaggattctctcgtgggtaacgctgtagccaggcaggaccagcctcttctgggagacccctctccccacgtagggtttgtgtagtgctcccacatcctgcttattgcctgccacccctgcttctcgcctggacctcttggtattccgtgtacaccatccttgctgtttcttgcctctgtgccttcaacctgctgctcctggcctgggataccttttattttcttttatttcttcttcctttttttttttttttttttttttaacctacaactagctctcagttcaggcactgtctaaagccccaggctgggttaggtggtctaggataccaactccccctcaacattttaccttaatccaacagtacagtaattagccgaaacttgcctggtttttcctactagactgtaagccctctagggacagggacagtgtcttattcatctctgtgttcttagtgcagagcctggcccgctgttggtgtttaataaagtgtgttgatctgaaatgccccagaccaacc

SEQ ID NO: 1868 - DNA, 1959 bp, Homo sapiens
gtaagcgctgcggagattgggctagaggcggaggcctgggccacggcggaggcgctgggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccggggataccgctacgtgattctggatatccccctgctgtttgagaccaagaagttgctcaagtacatgaagcacaccgtggtagtatactgcgaccgggacacacagctggcacggctgatgcggcggaacagcctgaaccgcaaggacgcagaggcccgcatcaatgcccagctgcccctgacagacaaggcccgcatggcccgccatgtcctagacaactcgggcgagtggagtgtcaccaaacgccaggtcatcctcttgcacactgagctggagcgctccctggagtacctgccgctgaggtttggggtcctcacagggctcgctgccattgccagcctcctctacctgctcacccactaccttctgccttacgcctagtggggcactcaaggcagggagccccaggcctccatctatctccttggaggctgaagccaggtaacacatcctgtttcctctcagccccctccccacacacacacacacacacacacacacacacacacacacacacacacacacacggactctccgaatcagggctgggcctctgtgccaggccatcccgtctttggagtgtatcctatttgagatcaagaaatagcctgctgtccttcccaccttccctgagcagcacctacagaacagcaaccgtgatggtgtgtgaaagcaacagtcagagactgctatacatttctgtgggtgggggtagggaatactggctctgtggccctcctcagagctgggaggccaagggttcactgggcttgaatcctctctaagcacctaccccattgtggcctaaacctcctcagtggaccacgggaaatcatgttggaccaagggtttccatgttcaaacagtcaacaaggccctcccctaggttgagatattttttatactgaaggcccaggccccccagtatggcttgctgccagcaagcagcaaggattctctcgtgggtaacgctgtagccaggcaggaccagcctcttctgggagacccctctccccacgtagggtttgtgtagtgctcccacatcctgcttattgcctgccacccctgcttctcgcctggacctcttggtattccgtgtacaccatccttgctgtttcttgcctctgtgccttcaacctgctgctcctggcctgggataccttttattttcttttatttcttcttcctttttttttttttttttttttttaacctacaactagctctcagttcaggcactgtctaaagccccaggctgggttaggtggtctaggataccaactccccctcaacattttaccttaatccaacagtacagtaattagccgaaacttgcctggtttttcctactagactgtaagccctctagggacagggacagtgtcttattcatctctgtgttcttagtgcagagcctggcccgctgttggtgtttaataaagtgtgttgatctgaaatgccccagaccaacc

SEQ ID NO: 1869 - DNA, 3286 bp, Homo sapiens
acctggctccgccccccaggacgccgagcctcggccgggcggtaaaatcggcgcttaccctttaagcggcgggacttctggtcacgtcgtccgcggtcgccggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcacttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaaggttgtctgtgttaagtttccatgtccctgctctgctgtctcttagatatcacataatttgtgtaaccaattatctcttgaagagcatttaggaagtacccagtattttttgctggattaattcctgg

SEQ ID NO: 1870 - DNA, 1994 bp, Homo sapiens
atgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcacttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggcc

SEQ ID NO: 1871 - DNA, 918 bp, Homo sapiens
agaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcacttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctg

SEQ ID NO: 1872 - DNA, 4209 bp, Homo sapiens
gctggcggaaggggaaatggggtgggtggggggtggggcaggcgacggtggggaagatggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgaccctttttggtctgtttgtgagcttagttttcttgggccaggcctttacaataatgctcgtctatgtgtggagccgaaggaacccctatgtccgcatgaacttcttcggccttctcaacttccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctattttgaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtataaggcagagccttttcttcctcttcttgatagatgaggccatggtgtaaatggaagtttcagagaggacaaaataaaacggaattccatttttctctcactgtattaaagcttttgtgtgtgatcttttaaattctgataatgtattgtagccctcctgcgtagatctgagctcagaacagtttacacagctgttcttcctgtgtcttcacaacttttaactggatttcatttcaggattggaaatacgtggctgtcatgctgtggttgtgtacatcttactaactcagaatgcaagattcagcaggaagatgatttatttctgtcatctggataggttgttttgcatctgggttttgccaaactttgtcagacaacatgaaaaaaaaggagggaggatggttcttgtagcagtaggaattcagctataggaaagtcagctgtaagctaatgtggcatcttatttgctttacttacatttctccattaagaagtatccagggaaagattggtaagggccacatttttgtaaaactaggaagattttcattagactttttttttcttttatttttaaaaaagttttaattaaaaatttttttttaaatacagatggggtctcactgtgttgcccaggctggtcttgaactcctggactcaagcaatcctcccacctcagcctcccaaagtgctaggatgacaggcatgagccaccatgcccagccattttttttttttttgccttttttgttttgttttgttttttgtttttttaattaaaaaaaaaaaatagagacagggtctcagattttcattagatttggaaaccaagttagaatgttgactttggagccagacgaacagataccagttagctaggcatatgttcttccagggtctttggctagttaacattagtcatttgcttcgtgaaaattcaagaaccttttcagagccaagtacctggattaccttcccaatcaggtagaaattagacagggtccacagaagtagacacttaatgctgtggttcaataaatacttcccctaaatattaagtcttccctgagtctcagcaggtttgcattcacactgcttaagtaacttccagaacctggaagagtcgaaagagcacccctaggaaagagatgattccaaacagctttcattaacggcatgtaggcacaggtccctttcccaaaagtggattgttagtagtagttcattcaacctttgttaaggggtagctttccagaatgtgacattgtcctcagaaagatagacataggcttaaacataatggacatcctaaataggaattttcagattgtttttgaagtgaaaagtgttttaatgtctttaaatggaattgcataactaatggtatttaagtattttacatgttgctaataactttgaatatgattgttgcaattttatggaacctgggtctatgggactgctttttaagcagtttaaaaaaggttttcaaagtttaaaagccaatcttagcatgtataatccttatgggattcttaagttttatcctatcttgtttttgctcaagaacgctttatcagtgacgtttgttagaattttgttttttgttttttttttttaaattgtttttgggctagaaatgagtttctctagttttatttgttctccctgagttggagttatgcaatgaatggcatttttgtggtaaaatactaatcctaaaatctgttaactcactgttcatttaagtagggaatatctgtatacattaatgactaggtaaaacaggaaatacattttgaatatacagcctaaaggcaggcagttacagggtttttgatttctccgattttatagggtgcaagttcccagtggcaggatgccctgctgtgtgactgactacactgtgtcctgagcagtggtaatttcaatcacctctcatcagtttggccagccctacaaccaccattcctagccctgtgttgcttgacaggatacctgtgcttgaatggacataaggaaaagtccttactttctccccaatttacctctcaatcttagttcttccagaacacacttccctttcacaatgcaaataaactgaaagtgagatttgatacatggaattttgagaccaaccaactaaccttacacataatttgagggattcctggattcttctagtgatactgaaaagcacacttgactaaagcatagtgttttttgtttgttatggaaatacggtatacgttcatttaaaaataaatggacatacaaattgcatctccttaggagatacattttatatacatttcggtgcgtttttttccagtatggatttctatttgtttctctcttcctcttgttttttctgtgtcactcttgtatgtcctcatatctttcatacctcttgtgtagtctctagaagcagaacacctaagtcctgggtctggataatgaaaccctcagtctctggggcctctgaaaataaggaagcattggagctattgccatgttgagtaatgggcttcctagaactattgtcatctatcctgccagtgttttatgttgtagctgtttttctttgacaggtgagttccagctatgttgttagtcatgatcctgccattattttctgtgttctgtaggatgtctccaggctacttaaacatattttatgagtttgcaataaaattgttgaatcttgtatgatcaagtcactcctctgctcagaaatccacagtgacttcttagtaagcccctacattatatgcatacttgtttttttcttaactttactcccacttctacctaacagggacctcaacttaagtctcttcagttcttcaaggcctggccttgttcctgattcctcaaaaaatcttgactctaaggcctattttattgtctgtctctgaatccctataaagcttcaagtctgtatgacattcttaacgccaaattatatattgtcttgtactgttcctagctggtacatgtatattagtcttgtctccctcatgagaatgtaagctccttaagggcagggaccatgtcttaatttttgtatccaccacagtgcctagcacagtgcttggcacatgggtgctgaataaatacctttgtttattgatcagcaaagta

SEQ ID NO: 1873 - DNA, 860 bp, Homo sapiens
gtgcttgagaaggttcaatggcgtggcagggactagcggccgagttcctgcaggtgccggcggtgacgcgggcttacaccgcagcctgtgtcctcaccaccgccgcggtgcagctggagctcctcagcccctttcaactctacttcaacccgcaccttgtgttccggaagttccaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccctgctgggactcctgggcagcctgttcttcctgggccaggccctcatggccatgctggtgtacgtgtggagccgccgcagccctcgggtgagggtcaacttcttcggcctgctcactttccaggcaccgttcctgccttgggcgctcatgggcttctcgctgctgctgggcaactccatcctcgtggacctgctggggattgcggtgggccatatctactacttcctggaggacgtcttccccaaccagcctggaggcaagaggctcctgcagacccctggcttcctaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgca

SEQ ID NO: 1874 - DNA, 969 bp, Homo sapiens
ggccacgcgtgcttgagaaggttcaatggcgtggcagggactagcggccgagttcctgcaggtgccggcggtgacgcgggcttacaccgcagcctgtgtcctcaccaccgccgcggtgcagctggagctcctcagcccctttcaactctacttcaacccgcaccttgtgttccggaagttccaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccctgctgggactcctgggcagcctgttcttcctgggccaggccctcatggccatgctggtgtacgtgtggagccgccgcagccctcgggtgagggtcaacttcttcggcctgctcactttccaggcaccgttcctgccttgggcgctcatgggcttctcgctgctgctgggcaactccatcctcgtggacctgctggggattgcggtgggccatatctactacttcctggaggacgtcttccccaaccagcctggaggcaagaggctcctgcagacccctggcttcctgtgagtgttgagagccctccctccctctccccaccctcagaaggatccccaccgatggggacctgtgctggcctgtgctcaacacgggcccctccccacagaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgca

SEQ ID NO: 1875 - DNA, 1063 bp, Homo sapiens
gcgtgcttgagaaggttcaatggcgtggcagggactagcggccgagttcctgcaggtgccggcggtgacgcgggcttacaccgcagcctgtgtcctcaccaccgccgcggtgcagctggagctcctcagcccctttcaactctacttcaacccgcaccttgtgttccggaagttccaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccctgctgggactcctgggcagcctgttcttcctgggccaggccctcatggccatgctggtgtacgtgtggagccgccgcagccctcgggtgagggtcaacttcttcggcctgctcactttccaggcaccgttcctgccttgggcgctcatgggcttctcgctgctgctgggcaactccatcctcgtggacctgctggggattgcggtgggccatatctactacttcctggaggacgtcttccccaaccagcctggaggcaagaggctcctgcagacccctggcttcctgggacttcagagcagcaaggccccagctggcagtagcctgaccatctggacacagcagagccagggcggcccagggacggcaggagagctcgcggcaccttcctgaggccaagcaaggggagcagggttagggctgttcctgaaaggcagagagcctcttgccctgagcctcacagctactcttctcagctctctgggtctggaaggagaacaggctgaggggagctgagaggagctgaggtgctacccggagccccattcacccccacctgcccacttgggaatctgaggcagaggagggtgaggcctgtgtgccaaccttgttcacataccaccttcgtccccccaggccccggccccactcctggctctcattatttttatgttaaaactttgaagaaattgaacatgacctgttgaagaaattgaa

SEQ ID NO: 1876 - DNA, 3816 bp, Homo sapiens
ggagagtgtctctaaggtgacactcgggtgcgcggcagcagcggcggttgcaggagctcgctctccgcccgggctccggctccgctccagccgtccggggggcgccgcggcgcgcagagcgcagcaccccgactccagccaggagcccccgcccccccggagcgcaggaggaccccggcccgcctctcccaggcgcagcgcccagcatctcgctgctcctgtcgtctaagcgtcggcgtcgctagggacctgcggaacccggcgctcccctccctccccgcctcgcgtccccggcccgggcggactggagactcgaacttgagcgggtgcccgaaaggccgcaggagccgcgggcggaaggcggccgcacgatggccgaggggcagggcggcggagggcagcgctgggactgggctggcggcggccgggcagccgaggaggaggtggtgcggcggcgatgccggcgcggggaggaggcccaggtcgcgcagccctggcccgagggttcccggggcacggccgctgggcccccggtggaggagcgtttccgccagctgcacctacgaaagcaggtgtcttacaggaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 1877 - DNA, 3337 bp, Homo sapiens
ggcacttcctggagcggcggcggcagcggcttcccgggcacctgggcgtggggagcgggggcgcgcggcgcggggcgggcggagcgagcgcgcgccatggaggtggcgggcggcgcggagcgggcgtgctgagccccggccgccggcccggcatgggcgtctcccgcgggccctccgccggccggggctagggccggatggagccgcgggacggtagccccgaggcccggagcagcgactccgagtcggcttccgcctcgtccagcggctccgagcgcgacgccggtcccgagccggacaaggcgccgcggcgactcaacaagcggcgcttcccggggctgcggctcttcgggcacaggaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacccctgctcccccagcggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggag

SEQ ID NO: 1878 - DNA, 4117 bp, Homo sapiens
tccccgcaggagtcggagaggatggcaggggccggaggccagcaccaccctccgggcgccgctggaggagcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagaccagtattaaagagggacagctattgaagcaaaccagttctttccaaaggtggaaaaagcgatacttcaaacttcgaggccgcaccctttactatgcaaaggactcaaagtctctgatatttgatgaagttgacctctcagatgctagtgtagctgaagcaagcacgaaaaatgctaacaacagcttcacgatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagcaagtggctgttcttgtagttttctgcatagataagtaagcaccactgaagcacctctgtggcttgatattttgctgtgggtgaaattttgatttgaggtattagaaaatatttttgtgccgaacaatacattccacaaagccattttctttttgtgcaaacctgacatgttcaaatatattcacaatggtaataaggtaggaggaatctgagacgattgcattgtctaaacagtggaattgcaaaatgtttactttccatagatctggtctgatggaatgttcctactgtgcaactgcataacaatatgtggttaaaacttcctaggtttcattacgggggggcattggccattttcttaaaatcataggttaggagactaaaatataaattaagttgtgatttgaatgtagattggtatcacctccaactcctagtgcttagtggtcaaatatgttgaaaacctttccaatactatgaatgaatgcaaatcttaatgcacg

SEQ ID NO: 1879 - DNA, 4246 bp, Homo sapiens
tccccgcaggagtcggagaggatggcaggggccggaggccagcaccaccctccgggcgccgctggaggagcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagaccagtattaaagagggacagctattgaagcaaaccagttctttccaaaggtggaaaaagcgatacttcaaacttcgaggccgcaccctttactatgcaaaggactcaaagtctctgatatttgatgaagttgacctctcagatgctagtgtagctgaagcaagcacgaaaaatgctaacaacagcttcacgatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctgttcagaaatggggcacagaggaagttgctgcttggctggatctgctcaatttgggagagtacaaagatatcttcatccgtcatgacatcagaggggctgaacttttgcatctggaaaggcgagatcttaaggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagcaagtggctgttcttgtagttttctgcatagataagtaagcaccactgaagcacctctgtggcttgatattttgctgtgggtgaaattttgatttgaggtattagaaaatatttttgtgccgaacaatacattccacaaagccattttctttttgtgcaaacctgacatgttcaaatatattcacaatggtaataaggtaggaggaatctgagacgattgcattgtctaaacagtggaattgcaaaatgtttactttccatagatctggtctgatggaatgttcctactgtgcaactgcataacaatatgtggttaaaacttcctaggtttcattacgggggggcattggccattttcttaaaatcataggttaggagactaaaatataaattaagttgtgatttgaatgtagattggtatcacctccaactcctagtgcttagtggtcaaatatgttgaaaacctttccaatactatgaatgaatgcaaatcttaatgca

SEQ ID NO: 1880 - DNA, 4296 bp, Homo sapiens
tccccgcaggagtcggagaggatggcaggggccggaggccagcaccaccctccgggcgccgctggaggagcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagaccagtattaaagagggacagctattgaagcaaaccagttctttccaaaggtggaaaaagcgatacttcaaacttcgaggccgcaccctttactatgcaaaggactcaaagtctctgatatttgatgaagttgacctctcagatgctagtgtagctgaagcaagcacgaaaaatgctaacaacagcttcacgatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctgttcagaaatggggcacagaggaagttgctgcttggctggatctgctcaatttgggagagtacaaagatatcttcatccgtcatgacatcagaggggctgaacttttgcatctggaaaggcgagatcttaagaacacagtaggagaaaaaagagacaccaaagaaaatggtaaacatatggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagcaagtggctgttcttgtagttttctgcatagataagtaagcaccactgaagcacctctgtggcttgatattttgctgtgggtgaaattttgatttgaggtattagaaaatatttttgtgccgaacaatacattccacaaagccattttctttttgtgcaaacctgacatgttcaaatatattcacaatggtaataaggtaggaggaatctgagacgattgcattgtctaaacagtggaattgcaaaatgtttactttccatagatctggtctgatggaatgttcctactgtgcaactgcataacaatatgtggttaaaacttcctaggtttcattacgggggggcattggccattttcttaaaatcataggttaggagactaaaatataaattaagttgtgatttgaatgtagattggtatcacctccaactcctagtgcttagtggtcaaatatgttgaaaacctttccaatactatgaatgaatgcaaatcttaatgcacg

SEQ ID NO: 1881 - DNA, 3449 bp, Homo sapiens
attattagaaatctttagtcatctcattccctgtgagctgaaaggggccttcaagaagagagttctcagagcagactcagctttaggtgctgaaatgaatttctcaagatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctgttcagaaatggggcacagaggaagttgctgcttggctggatctgctcaatttgggagagtacaaagatatcttcatccgtcatgacatcagaggggctgaacttttgcatctggaaaggcgagatcttaaggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagc

SEQ ID NO: 1882 - DNA, 3004 bp, Homo sapiens
atcattagattgaattatccctttcagatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaaggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagc

SEQ ID NO: 1883 - DNA, 3601 bp, Homo sapiens
gaacgtcacaaggaagaaacggtgcccggcgcagcttgccctggagcgtagctggagtgcggctgagttttcgctccgctgaagccggagtcggagaggatggcaggggccggaggccagcaccaccctccgggcgccgctggaggagcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagaccagtattaaagagggacagctattgaagcaaaccagttctttccaaaggtggaaaaagcgatacttcaaacttcgaggccgcaccctttactatgcaaaggactcaaagtctctgatatttgatgaagttgacctctcagatgctagtgtagctgaagcaagcacgaaaaatgctaacaacagcttcacgatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctggatctggggataccgaaagtgggtcatgtgaagcgaattctccagggaattaaagagctt

SEQ ID NO: 1884 - DNA, 3213 bp, Homo sapiens
gtgctgagccccggccgccggcccggcatgggcgtctcccgcgggccctccgccggccggggctagggccggatggagccgcgggacggtagccccgaggcccggagcagcgactccgagtcggcttccgcctcgtccagcggctccgagcgcgacgccggtcccgagccggacaaggcgccgcggcgactcaacaagcggcgcttcccggggctgcggctcttcgggcacaggaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggc

SEQ ID NO: 1885 - DNA, 3385 bp, Homo sapiens
gccgggggaagctgcaatgaatcctcagctctgggcccagtggaggcgctggggacggaagaaggggagcggccggggtcactgaggcagatgtggcgctaccgctcctgggacgtgccacagatcccatcagaggcaccccagacacagaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 1886 - DNA, 2862 bp, Homo sapiens
gtgctgagccccggccgccggcccggcatgggcgtctcccgcgggccctccgccggccggggctagggccggatggagccgcgggacggtagccccgaggcccggagcagcgactccgagtcggcttccgcctcgtccagcggctccgagcgcgacgccggtcccgagccggacaaggcgccgcggcgactcaacaagcggcgcttcccggggctgcggctcttcgggcacaggaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtag

SEQ ID NO: 1887 - DNA, 4086 bp, Homo sapiens
tgctagctctccaaactaggacttgctcagcagaggccgccagcccggagctggatccagagcccggccttggggaccccagctcccacctgcgccctgccttccagatcagccaaccgcctgccatggagactttctttaggagacatttccgggggaaggtgccaggccctggagaggggcagcagcggcccagcagcgtggggctgcccacaggcaaggcccggcgtcgctcccccgctgggcaggcctcctcctcactggcacagcggcgccgctccagcgcccagctccagggctgcctcctgagttgcggggtgagggcccagggttccagccgccggcgctccagcactgtgcccccttcctgcaacccccgcttcatcgtggataaggtgctcactccacagcctaccaccgtgggggcccagcttctgggtgcacccctgctgttgaccgggcttgtgggcatgaatgaggaggagggtgtccaggaggatgtggtagccgaggcatcgagcgccatccagccaggcaccaagacaccagggccacccccacctcggggcgcccagccgctgttgcccctaccccgctacctgcgccgagcctcctcccacctgctccccgcggatgccgtatatgaccacgctctctggggcctgcacggctactatcggcgcctcagccagcggcggccctcaggccagcaccctggccctgggggccgaagagcctcaggcaccaccgccggcaccatgctgcccacccgtgtgcgcccactgtcccgcaggcgccaggtagccctacggcgcaaggcggccggaccccaggcctggagcgccctgctcgcgaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 1888 - DNA, 3482 bp, Homo sapiens
gcggcgcggagcgggcgtgctgagccccggccgccggcccggcatgggcgtctcccgcgggccctccgccggccggggctagggccggatggagccgcgggacggtagccccgaggcccggagcagcgactccgagtcggcttccgcctcgtccagcggctccgagcgcgacgccggtcccgagccggacaaggcgccgcggcgactcaacaagcggcgcttcccggggctgcggctcttcgggcacaggaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 1889 - DNA, 1707 bp, Homo sapiens
ggcggcgggcaggcagcggcccggccagctatgcggggtcctgcggccgcggctggcggcacttcctggagcggcggcggcagcggcttcccgggcacctgggcgtggggagcgggggcgcgcggcgcggggcgggcggagcgagcgcgcgccatggaggtggcgggcggcgcggagcgggcgtgctgagccccggccgccggcccggcatgggcgtctcccgcgggccctccgccggccggggctagggccggatggagccgcgggacggtagccccgaggcccggagcagcgactccgagtcggcttccgcctcgtccagcggctccgagcgcgacgccggtcccgagccggacaaggcgccgcggcgactcaacaagcggcgcttcccggggctgcggctcttcgggcacagtaaatccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 1890 - DNA, 1553 bp, Homo sapiens
cacagtaagagattatagcaaagcatctataatcaactcagcttaagaagttttgaccttctggttaggcttcttgccacaacagaacagcaccataaccatggctttcttctcccgactgaatctccaggagggcctccaaaccttctttgttttgcaatggatcccagtctatatatttttaggagctattcccattctccttataccctactttctgttattcagtaagttctggcccttggctgtgctctccttagcctggctcacctatgattggaacacccacagtcaaggtggcaggcgttcagcttgggtacgaaactggaccctatggaagtatttccgaaattacttcccagtaaagctggtgaagactcatgatctttctcccaaacacaactacatcattgccaatcacccccatggcattctctcttttggtgtcttcatcaactttgccactgaggccactggcattgctcggattttcccatccatcactccctttgtagggaccttagaaaggatattttggatcccaattgtgcgagaatatgtgatgtcaatgggtgtgtgccctgtgagtagctcagccttgaagtacttgctgacccagaaaggctcaggcaatgccgtggttattgtggtgggtggagctgctgaagctctcttgtgccgaccaggagcctccactctcttcctcaagcagcgtaaaggttttgtgaagatggcactgcaaacaggggcataccttgtcccttcatattcctttggtgagaacgaagttttcaatcaggagaccttccctgagggcacgtggttaaggttgttccaaaaaaccttccaggacacattcaaaaaaatcctgggactaaatttctgtaccttccatggccggggcttcactcgcggatcctggggcttcctgcctttcaatcggcccattaccactgttgttggggaaccccttccaattcccaggattaagaggccaaaccagaagacagtagacaagtatcacgcactctacatcagtgccctgcgcaagctctttgaccaacacaaagttgaatatggcctccctgagacccaagagctgacaattacataacaggagccacattccccattgatcaacccccaaagccatgagggatccaagtagagccacagaaaaagaagaattccaggagagggaaagatcgtaaggatgagagaggagaccatccaagccagaaattatttaataaatcagagttctagcaatagagtcctctcccaagtggctgaggcaggcttaggggaaagaaccagaggggcaggggaggactggggagggctggctagccagaggagttggctgtatcacccctggttattttagggcaacaacccagttggggagtcttatgaatcattccagccaactctctgatcacaaagaatactgtgcccctttctcctaaaccttagttcaccatcactacgtaggtttagacttagaagctttatttggaacagggatagtttgtttcctcttggtcctttcc

SEQ ID NO: 1891 - DNA, 599 bp, Homo sapiens
ggaggggaccaacgggctccggcgctgacaccgcggcactcatgccctgtcccctttcagctgtttccagcatactgtgccccgtctgtcctcaggccagggcttcgctgcagccccggccactccctagtgcctggcccggtggtggccaggcagttggccgcgctgcttctcccgcagaggggacccccactgggggcgaaggcttggcctgccctcttcactgctgtatttccagacctgatgcctgcgtttgctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcg

SEQ ID NO: 1892 - DNA, 714 bp, Homo sapiens
gtgcacagccaggctgcgaaggtgcagcgggcgggaggcccgttgggggctcagccggctgccagaagctctcgggctctttccttccgtgcccctcacttgctcatgggcccatgcctagccctgattcgttggacagagcctttgtagacccttgtctgagaccgagctatgtggggcgacctctggctcctcccgcctgcctctgccaatccgggcactgggacagaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaataa

SEQ ID NO: 1893 - DNA, 627 bp, Homo sapiens
ggtgctcgcccgagcagggttggggcgagtggaccgcgcctctaaaggcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaataacttt

SEQ ID NO: 1894 - DNA, 576 bp, Homo sapiens
gcgatcgcttcctggtcctcgcctcctccgctgtctccctggagttcttgcaagtcggccaggatgtctcagtgtagacccttgtctgagaccgagctatgtggggcgacctctggctcctcccgcctgcctctgccaatccgggcactgggacagaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgat

SEQ ID NO: 1895 - DNA, 687 bp, Homo sapiens
agtgcaatctgggcgatcgcttcctggtcctcgcctcctccgctgtctccctggagttcttgcaagtcggccaggatgtctcagcacagggcaggacgtcgcggcggagtggggaagcgaggagtccgtggccgagagcttggaggtcaggggaagtacggggccggctgctcagagtgcgggacgaggagaatcgcggcccggggagaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttacttt

SEQ ID NO: 1896 - DNA, 672 bp, Homo sapiens
agtgcaatctgggcgatcgcttcctggtcctcgcctcctccgctgtctccctggagttcttgcaagtcggccaggatgtctcaggtacagcgcgtgcacagccaggctgcgaagacccttgtctgagaccgagctatgtggggcgacctctggctcctcccgcctgcctctgccaatccgggcactgggacagaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttacttt

SEQ ID NO: 1897 - DNA, 753 bp, Homo sapiens
tgcccaccccgcaactgccggaaagttgcccatggggtggacttcgctgtgtagcgggagaggggtgggagtcgagggtgcttgatggagagatgggggaaggggttgcacggattggaggagcgaggagactcagtccccatcccgaagcacagggcaggacgtcgcggcggagtggggaagcgaggagtccgtggccgagagcttggaggtcaggggaagtacggggccggctgctcagagtgcgggacgaggagaatcgcggcccggggagaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttacttt

SEQ ID NO: 1898 - DNA, 3927 bp, Homo sapiens
gagatactgatttgctcgcgctatagaattcttgtcgaagaggcttagctcccgcgggagatttcgtgcgcagttacttccggtagctggtaaaggctgatacttcccaggacgcggaggtaacgggccagggccaaagcgactttcgctacttggattggtcggcgtagctttgggcggccggaccttagaaagtcacacatctgcgcgcctgtgcggcccctgcttctgcggatgctgaggcacgtaaaaaaatttgaagaagggaatttcgcggcattcttggcctggcttcctggcgtagccagcaagttcggaggtgttaaccgctgctgtcatgtttcttttgctaaactgcatcgtcgctgtgtcccaaaacatgggcatcggcaagaacggggacctgcccaggccgccgctcaggaatgaattcaggtatttccagagaatgaccacaacttcttcagtagagggtaaacagaatctggtgattatgggtaggaagacctggttctccattcctgagaagaatcgacctttaaaggatagaattaatttagttctcagcagagaactcaaggaacctccacaaggagctcattttcttgccagaagtttggatgatgccttaaaacttactgaacgaccagaattagcaaataaagtagacatgatttggatagttggtggcagttctgtttataaggaagccatgaatcacctaggccatcttaaactatttgtgacaaggatcatgcaggactttgaaagtgacacgtttttttcagaaattgacttggagaaatataaacttctgcctgaatacccaggtgttctctctgatgtccaggaggggaaacacatcaagtacaaatttgaagtatgtgagaaggatgattaatatgaaggtgttttctggtttaagttgttccccctccctctgagaaaagtatgcatttttacattagaaaagggacttttgttgacttcagatctatggataattatttctaagcaacgtgtttttattcctcactaatcttggctatatcagataccatttatgaaacattcttgctataactgtctctccaagaccccgactgagtccccagcacctgctacagtgagctgccattccacacccatcacatgtggcactcttgccactccttgacattgtcaggcttttctaatgttggtagtatttattaaagatgaagatgcacatacccttcagctgagcagtttcactagtaggaaataccaaaagcttcgtacatgtatatccagaggtttgtagacaaatgttgcagccttttttgtaacagtgaaaaactgaaaacaacctggaagtccagtgatgggaaaatgaatatatttctgtcttagattggggaacccaaagcagattccaagactgaaatttaagtgaaagcagtttatttgctaggtcataccagaagtcatcaatcgaagtatggagaaatggaactgagaaggtaaaaaccagttcaaaatcagtgaggaggttctcaatggtaacgagctccatactgctgagatacagggaaacggaggggagaaagctagagtatttaacccccactccttggttgtcagctccctgtcctgtgtgtgggcagaacgtactccacctactcaatagcaagttccaggtgtttgctgaaagaagctgctgtaatgtacgggaacggtgaatgccaaacacttaaagcaattccatgtttaagtatgtaaactcttcatacttttttttttttttctttttaagacagaatttcactcttgttgcccaggcggagtgcaatggaacaaccttggctcacggcaacttcagccttcccaggttcaagcaattctcctgcctcaggctcctgggtggctgggactacaggcgcgtgccaccacgccaggctaattttgtatttttggtggggacattccatgttggtcaggctagtctcgaactcctgacctcaggtgatcctcctgcctcggccttcaggggtgctgggattacaggcatcagccactgcacttggcagatcttcattcttttagtaaaaagtataaagccacacatggtttatttgaaatattttataatttaaaaaagtacagaagcaggaaaaccaattctaggttcaagtgagggatgatggtagtttgaaccaaaggattgcatgtggtaagaaattgtgatttaagatatattttaaagttggaagtagcaggatattctgatggagtttgactttggttttgggcccactgagtttgagatgcctttgagaaatgaaagaagtagagagagaattaaaaactggccaggagtggtggctcacgcctgtggtcccagcactttggggggctgaggtgggtggatcacctgagaccagcttgggcaacatggtggagccctgtctctacagaagatacaaaaattggctgggcattgtggcacacacctgtagtctcgtctactcacggggctgagatggaggattcaattgagcccatgagttcaaggctgcagtgagtcgtgattttgccactgcactcctgcctgggtgacagaagagaccctgtctcaaaaaagaatctgaaaacaacggaaccatgccttcagaattctataaagttattttcaactgataaatctatattcaggcaaagaatcaagggtgaaggtaaaataatacatttttagacaagcaaagactcaggggttacatgtaccctttcttgggaagctatcggagaaaatactccagcaaaatgaaggcgtacacaaaccagagaatgacgtggatccagcaaatagtatccaacacaggcaatattccagctatggagctagctttaaaaagaaacagtaaaaatactaatagattagctgggtgggatggcccatgcttgtagtcccagctactcaggaggctaagcaaaaggatggcttgagcccaagagttcagagcagcctggccaccatagtgagatcccttctcttaaaaataataggttattgccagatttggggcatttggaaagaagtgcattgaagataaagcaaaagtaaaaaaaaaaaaaaacaaaaaaaaacaagggggaagggttggttaggcaataattaattctagggcaggaagaagtacaggataggaagtaagagcatcatacgctgtttttctcaacaatgggcaatatgtacatagtcataatgatgtggtgactgactgcttagcccctaaatctggtaactactttgggacaatatggggggaaaagtgaagatagtgatggtgtaagagctaaatcctcatctgtcatatcaagaaatcactatataatgtataacataatcaagaaatgactaagtagttatgtgaagaaaagaatggaacattgctagaagagttagaagtcattgctccagagaattaggagggatggggcaggggactgttaggatgcattataaactgaagaggcttttaaagattacatgtattaatatatgtattcacttgaaaaactaaaaaaatagtaattttttaaaacccatggaggtaactaccagaaggaaaaactaagagaatgaaaagtgctttcctctggaaagaacaagtcgcaggactgttttcattgtaagacttttggagccatttgattttacttaaccattttcatatatttctttaataaaaataattctatcttaataaaaagttacactcattcattaaaaaaagaattttaagactgtaataagaatcatagtttatttctgttagagaaaggcaatgtgttatacttggaaagaggtcatattaattttatcacatttttgggactcagcatctttatattttctgattttaaataaacaactttgcttatgaa

SEQ ID NO: 1899 - DNA, 4038 bp, Homo sapiens
atcccagcaccctccctcgccacctcggccgcgtccagaagcgtctcattcagatagaggtacccagccgggccccaggtctcacctgggtcagcattgtcccgctgagagctttcaaacaacaggtgtacgcgaatcagtatcaaaaagcctccagggaactgaaaaaaacagtctgacttccgggattcgcgggcatccactttcattctcacgtttcctcttcaatttctcgcgagatactgatttgctcgcgctatagaattcttgtcgaagaggcttagctcccgcgggagatttcgtgcgcagttacttccggtagctggtaaaggctgatacttcccaggacgcggaggcacgtaaaaaaatttgaagaagggaatttcgcggcattcttggcctggcttcctggcgtagccagcaagttcggaggtgttaaccgctgctgtcatgtttcttttgctaaactgcatcgtcgctgtgtcccaaaacatgggcatcggcaagaacggggacctgcccaggccgccgctcaggaatgaattcaggtatttccagagaatgaccacaacttcttcagtagagggtaaacagaatctggtgattatgggtaggaagacctggttctccattcctgagaagaatcgacctttaaaggatagaattaatttagttctcagcagagaactcaaggaacctccacaaggagctcattttcttgccagaagtttggatgatgccttaaaacttactgaacgaccagaattagcaaataaagtagacatgatttggatagttggtggcagttctgtttataaggaagccatgaatcacctaggccatcttaaactatttgtgacaaggatcatgcaggactttgaaagtgacacgtttttttcagaaattgacttggagaaatataaacttctgcctgaatacccaggtgttctctctgatgtccaggaggggaaacacatcaagtacaaatttgaagtatgtgagaaggatgattaatatgaaggtgttttctggtttaagttgttccccctccctctgagaaaagtatgcatttttacattagaaaagggacttttgttgacttcagatctatggataattatttctaagcaacgtgtttttattcctcactaatcttggctatatcagataccatttatgaaacattcttgctataactgtctctccaagaccccgactgagtccccagcacctgctacagtgagctgccattccacacccatcacatgtggcactcttgccactccttgacattgtcaggcttttctaatgttggtagtatttattaaagatgaagatgcacatacccttcagctgagcagtttcactagtaggaaataccaaaagcttcgtacatgtatatccagaggtttgtagacaaatgttgcagccttttttgtaacagtgaaaaactgaaaacaacctggaagtccagtgatgggaaaatgaatatatttctgtcttagattggggaacccaaagcagattccaagactgaaatttaagtgaaagcagtttatttgctaggtcataccagaagtcatcaatcgaagtatggagaaatggaactgagaaggtaaaaaccagttcaaaatcagtgaggaggttctcaatggtaacgagctccatactgctgagatacagggaaacggaggggagaaagctagagtatttaacccccactccttggttgtcagctccctgtcctgtgtgtgggcagaacgtactccacctactcaatagcaagttccaggtgtttgctgaaagaagctgctgtaatgtacgggaacggtgaatgccaaacacttaaagcaattccatgtttaagtatgtaaactcttcatacttttttttttttttctttttaagacagaatttcactcttgttgcccaggcggagtgcaatggaacaaccttggctcacggcaacttcagccttcccaggttcaagcaattctcctgcctcaggctcctgggtggctgggactacaggcgcgtgccaccacgccaggctaattttgtatttttggtggggacattccatgttggtcaggctagtctcgaactcctgacctcaggtgatcctcctgcctcggccttcaggggtgctgggattacaggcatcagccactgcacttggcagatcttcattcttttagtaaaaagtataaagccacacatggtttatttgaaatattttataatttaaaaaagtacagaagcaggaaaaccaattctaggttcaagtgagggatgatggtagtttgaaccaaaggattgcatgtggtaagaaattgtgatttaagatatattttaaagttggaagtagcaggatattctgatggagtttgactttggttttgggcccactgagtttgagatgcctttgagaaatgaaagaagtagagagagaattaaaaactggccaggagtggtggctcacgcctgtggtcccagcactttggggggctgaggtgggtggatcacctgagaccagcttgggcaacatggtggagccctgtctctacagaagatacaaaaattggctgggcattgtggcacacacctgtagtctcgtctactcacggggctgagatggaggattcaattgagcccatgagttcaaggctgcagtgagtcgtgattttgccactgcactcctgcctgggtgacagaagagaccctgtctcaaaaaagaatctgaaaacaacggaaccatgccttcagaattctataaagttattttcaactgataaatctatattcaggcaaagaatcaagggtgaaggtaaaataatacatttttagacaagcaaagactcaggggttacatgtaccctttcttgggaagctatcggagaaaatactccagcaaaatgaaggcgtacacaaaccagagaatgacgtggatccagcaaatagtatccaacacaggcaatattccagctatggagctagctttaaaaagaaacagtaaaaatactaatagattagctgggtgggatggcccatgcttgtagtcccagctactcaggaggctaagcaaaaggatggcttgagcccaagagttcagagcagcctggccaccatagtgagatcccttctcttaaaaataataggttattgccagatttggggcatttggaaagaagtgcattgaagataaagcaaaagtaaaaaaaaaaaaaaacaaaaaaaaacaagggggaagggttggttaggcaataattaattctagggcaggaagaagtacaggataggaagtaagagcatcatacgctgtttttctcaacaatgggcaatatgtacatagtcataatgatgtggtgactgactgcttagcccctaaatctggtaactactttgggacaatatggggggaaaagtgaagatagtgatggtgtaagagctaaatcctcatctgtcatatcaagaaatcactatataatgtataacataatcaagaaatgactaagtagttatgtgaagaaaagaatggaacattgctagaagagttagaagtcattgctccagagaattaggagggatggggcaggggactgttaggatgcattataaactgaagaggcttttaaagattacatgtattaatatatgtattcacttgaaaaactaaaaaaatagtaattttttaaaacccatggaggtaactaccagaaggaaaaactaagagaatgaaaagtgctttcctctggaaagaacaagtcgcaggactgttttcattgtaagacttttggagccatttgattttacttaaccattttcatatatttctttaataaaaataattctatcttaataaaaagttacactcattcattaaaaaaagaattttaagactgtaataagaatcatagtttatttctgttagagaaaggcaatgtgttatacttggaaagaggtcatattaattttatcacatttttgggactcagcatctttatattttctgattttaaataaacaactttgcttatg

SEQ ID NO: 1900 - DNA, 1831 bp, Homo sapiens
ggtaaaggctgatacttcccaggacgcggaggcacgtaaaaaaatttgaagaagggaatttcgcggcattcttggcctggcttcctggcgtagccagcaagttcggaggtgttaaccgctgctgtcatgtttcttttgctaaactgcatcgtcgctgtgtcccaaaacatgggcatcggcaagaacggggacctgcccaggccgccgctcaggaatgaattcaggtatttccagagaatgaccacaacttcttcagtagagggtaaacagaatctggtgattatgggtaggaagacctggttctccattcctgagaagaatcgacctttaaaggatagaattaatttagttctcagcagagaactcaaggaacctccacaaggagctcattttcttgccagaagtttggatgatgccttaaaacttactgaacgaccagaattagcaaataaagtagacatgatttggatagttggtggcagttctgtttataaggaagccatgaatcacctaggccatcttaaactatttgtgacaaggatcatgcaggactttgaaagtgacacgtttttttcagaaattgacttggagaaatataaacttctgcctgaatacccaggtgttctctctgatgtccaggaggggaaacacatcaagtacaaatttgaagtatgtgagaaggatgattaatatgaaggtgttttctggtttaagttgttccccctccctctgagaaaagtatgcatttttacattagaaaagggacttttgttgacttcagatctatggataattatttctaagcaacgtgtttttattcctcactaatcttggctatatcagataccatttatgaaacattcttgctataactgtctctccaagaccccgactgagtccccagcacctgctacagtgagctgccattccacacccatcacatgtggcactcttgccactccttgacattgtcaggcttttctaatgttggtagtatttattaaagatgaagatgcacatacccttcagctgagcagtttcactagtaggaaataccaaaagcttcgtacatgtatatccagaggtttgtagacaaatgttgcagccttttttgtaacagtgaaaaactgaaaacaacctggaagtccagtgatgggaaaatgaatatatttctgtcttagattggggaacccaaagcagattccaagactgaaatttaagtgaaagcagtttatttgctaggtcataccagaagtcatcaatcgaagtatggagaaatggaactgagaaggtaaaaaccagttcaaaatcagtgaggaggttctcaatggtaacgagctccatactgctgagatacagggaaacggaggggagaaagctagagtatttaacccccactccttggttgtcagctccctgtcctgtgtgtgggcagaacgtactccacctactcaatagcaagttccaggtgtttgctgaaagaagctgctgtaatgtacgggaacggtgaatgccaaacacttaaagcaattccatgtttaagtatgtaaactcttcatacttttttttttttttctttttaagacagaatttcactcttgttgcccaggcggagtgcaatggaacaaccttggctcacggcaacttcagccttcccagctactcaggaggctaagcaaaaggatggcttgagcccaagagttcagagcagcctggccaccatagtgagatcccttctcttaaaaataataggttattgccagatttggggcatttggaaagaagtgcattgaagataaagcaaaagtaaaaaaaaaaaaaaacaaaaaaa

SEQ ID NO: 1901 - DNA, 591 bp, Homo sapiens
aaaacaaatctcagccctccaagagctggagggagtgggtactagaagtctgcgagctggacggaagggactcagcattacagcactcagcattatttcagggcttgacagtaaagccaaagaaacgctgatctcgcgaggggacgaacaaaggcacgtaaaaaaatttgaagaagggaatttcgcggcattcttggcctggcttcctggcgtagccagcaagttcggaggtgttaaccgctgctgtcatgtttcttttgctaaactgcatcgtcgctgtgtcccaaaacatgggcatcggcaagaacggggacctgcccaggccgccgctcaggaatgaattcaggtatttccagagaatgaccacaacttcttcagtagagggtaaacagaatctggtgattatgggtaggaagacctggttctccattcctgagaagaatcgacctttaaaggatagaattaatttagttctcagcagagaactcaaggaacctccacaaggagctcattttcttgccagaagtttggatgatgccttaaaacttactgaacgaccagaattagcaaataaagtagacatgatttgga

SEQ ID NO: 1902 - DNA, 3397 bp, Homo sapiens
ggctcgggcgggcggggggcggcggcgccagcggacaccggagcgggcaggagcagcggccgcggcgccgcagggaccagcgggcccaggctcggtctggggttcttgcagctggcaccagccctcccggccccggccgcccacccgccgcggggaagatgccggaacagagtaacgattaccgcgtggtggtgttcggggcgggcggcgtgggcaagagctcgctggtgctgcgcttcgtgaagggcacgttccgcgacacctacatccccaccatcgaggacacctaccggcaggtgatcagctgcgacaagagcgtgtgcacgctgcagatcacagacaccaccggcagccaccagttcccggccatgcagcgcctgtccatctccaagggccacgccttcatcctggtgttctccgtcaccagcaagcagtcgctggaggagctggggcccatctacaagctcatcgtgcagatcaagggcagcgtggaggacatccccgtgatgctcgtgggcaacaagtgcgatgagacgcagcgggaggtggacacgcgcgaggcgcaggcggtggcccaggagtggaagtgcgctttcatggagacctcggccaagatgaactacaacgtcaaggagctcttccaggagctgctgacgctggagacgcgccggaacatgagcctcaacatcgacggcaagcgctccgggaagcagaagaggacagaccgcgtcaagggcaaatgcaccctcatgtgagcccggaacgcccgcctgcccgccgcccacccccactgacccccgctgcctcccccaacaccgacaccctcctcggcctcctcctcttctctcatccttcctccgacacctcggctggggaaaccgaggccaccgcccccccctccgctgcccctgcccaccccgaggcagggctggggcttttcttcctcccctgctctctctccaccctcctgttctgtctgtaccctccaaaaccaagagccggaggtggcccccttgtcctgcagatgggaaaacaggatggggagctggcaagaggagctgcttgttcccaccaggaccagaggaggctgcgtttccccgtttccatctctttccctggggtgtccccagccagacctgcgcgtcctgtccctcacatttgatcactgtgaccttctgggggaggggggagttgaaaatgcacatcggcctcagatatttttttcttttttctcctatttggtgttaacatacacccaagcccacccggcccgtcgtgacctctgatctgtgcccactcctccggttccagacgcacctctctcctctgtcttcacagtggggtgtggggcccgtgggatgggcctcaggccaccaggcaataaccacagggcctgcagcagtgcccctgccagccccgaatcccacccccgggaccagccacatccacagcacaactgccccgctggagaggcaccatgggcgtggaggggcttcccggacaccgcccacccgggacccgcctcttccaccaagacagagacgttagcaacgcatggcgggtggggacctggggtgctcaggagggggtacccggggccccggccagagatacatcaattacacccccgtggggggacagccgatgggagccagcaccagcaggatccgagggcgccccggacagaggtctgccccacccacttcctccccaccacctgtgccccagagagcagggcctgcccgggaaggtggcgtcctggagtcgagtgtacctgcagccatgaggttctgggtgttttttgagagagtctgagtgacaccacactcgtgtgaccccacagggttgtgtccaacatacacggaagtggctatggaatggtgtatttgtgcaacctggggtgcgcggatgggtgacttgtatctaagtgcatctgcgtgtatacctgtgtgtgtctgtctgggatgatatgtttttgtggcagtctgtgtgtgtaatagtggtgtagggtatacagagaggtgggtagttgtagatacctgtgtgtggttgtcagcaagactggatatgtgtgaggtgtctgtgtgaatctttgtgcctgtatgagcatgactatattttggggagtgggtgatatggtttatctgagagcatttatctgtaaatatgtttgtcctgattgagggacacgatctgtgttccactctatagcaacatgactctagcaatgtgactttcggttccaaatctgtatcagtcagctactgctgtgtaacaaatgaccacaaatgtagcaaccagaaacaacacatgcttattatctcatagattctgtgggtcaagagcctgggtgcaggttggctgggtcctctacttgggatctcaggaggctgcaatcaaagcattcgccaggcagaggtctcatctgaaggcctgatcggggaaggatttgcttcttagaagctcatgtggttgttgcagcattcagttccttgctgttgcaagactgaaggcctcagttcctcgctggctgttggctggaagctgccctttgttctgtaccatgtgggtctctccacagcggggctcggagcatggcagctaagttagtgagggaaggtgagatggaggttttggtcttattgggtgtgaggaagcaacgtgtgtgtgtgcgcacgcccttttgtgcagtgagagagagagagagattgcacacatgtgtctctgtagtcatgtggccaggtgggactatgtaggtaacagattgctcgtgtctgatttggtacaagcatgtttgttttcctctgtgttcgtgtgagtgtttactcaacaaatgtttattggacacactcagagagagggagtgtgcacacgtgcgtgtgtgttgctatccagcacgtggaccgggctcccagaagagctggcattgtgtctgagcagagctgggtccccccaaaacttgggctggcccagggcccaccagcagctgatgttgcctcctctcctgtcctggcagtagcttctgggttctgaaggtgccggagagagtgaggctgggcaggggtctgcggccctttctcagggacacaccctgatagcacaatctccttggggccctgcccacctccaggcctctcccacctcaggccctgcccgaccctggggagagagggcatctgcaataggaggggacccgagcctgtcctggctgctggcccatcctgcctgggcatccctggtgctggggactgtgccaggccatgcttgctgtgactccgcccctgccccctctccccccgcatgtgggtgcccccactcccccatcgtggggtctgtgtagccttcgctctagacatagtcttcctgcaataaaaaagtggatcctgcattccccacc

SEQ ID NO: 1903 - DNA, 4385 bp, Homo sapiens
tttaagcaggagcagcagcctctgcagcagttggcacatctgagaaggcagagattgaagagagtaggaggagcgtgcagcggcggtgacagtgccaggccggagcggctcaggccagcgcaggtgcaggggctgcgagcgggtggagcgcgagggcgctgggcgcagggagcacggccggtgggcggtgcagggcgcacggcgggcgagcagctgacagcatcgtcacggcggcgggagggagtgcgctgcgcctgcctccgggaggagccgcatccacacaccctgcgctgccctgtcctgcgcgagtggagctctgaagaagctctgagcggagttgtgttcttccccaggtgcgtcctggctgagagttggagctctccagcaacatgcctgagcagagtaacgattaccgggtggccgtgtttggggctggcggtgttggcaagagctccctggtgttgaggtttgtgaaaggcacattccgggagagctacatcccgacggtggaagacacctaccggcaagtgatcagctgtgacaagagcatatgcacattgcagatcaccgacacgacggggagccaccagttcccggccatgcagcggctgtccatctccaaagggcacgccttcatcctggtgtactccattaccagccgacagtccttggaggagctcaagcccatctacgaacaaatctgcgagatcaaaggggacgtggagagcatccccatcatgctggtggggaacaagtgtgatgagagccccagccgcgaggtgcagagcagcgaggcggaggccttggcccgcacatggaagtgtgccttcatggagacctcagccaagctcaaccataacgtgaaggagcttttccaggagctgctcaacctggagaagcgcaggaccgtgagtctccagatcgacgggaaaaagagcaagcagcagaaaaggaaagagaagctcaaaggcaagtgcgtgatcatgtgaaggcccttcctgcgggaggagcagctgtgtgtccccggcacctcactcccccaaaatgacacccaccgtcgtcagggtagcatgtataatgcccacgtgttaaacattgcatttaatcgagatgcgtcctattgtccttaagagggcgtttcacaccaccaacagtaagccacccactctggagtcacagaatctgccaggcggttcaagtgaaaaccaacacactcagcatccctgggaactgagaggtgccagcaattgctgaaggtggcgatgaacacccgaaggtgggagggaggactggtacccacaaagcaacatgtaccgagaggactaaatgtcatctacgtgcatgtgagagcgtgttaacctagagttacctgcaccaaccccagacagaagccaatcacatctttgggggaggggaggggcaggaagaggtgagaagatcagatggtccaaagtggaccacacttggtccattttacacttttttaaaggggattaaaaaacacagcctctcccccaaagggtgtccgttcttaattcccacctggcctgttaggagccttgctaccctgaggggatgtgttcaccttacctagacctagttaggaagtatcattttaagctattagagtatttatcttcatgtgcagggataagtgcactaacagtgtgctgctctgtcggaagttcttcagtttttaagtgaggatatcgtgacagtattaaaacatcgcaataatgttcctgtgtgttatacatcgagggttttagaaatgtgattttcttcttttgacctgtgaggagtataacttctttcagccctcagattttaaatacaagcaaataaactcactatttttagacgtttttttcctccaaggtggttttcttctcttaaataactcgatctgtacccagctgggtagcagccagcaaaggccatcagacaaccagaagcacatccatttttgtagtgtcacaaacatgtatatgccacactttgcaccttaatgaaatactttgaaacagaagttattcactgtgtttttgatgatctatctgtattggaaatatgttcctggaaaatgcatttaaataatagtaaattctcttgcatgttccattatacgtgtcttctaagagctgttcaatacagtattcactctagaaacaattatctttttctcttaatgattttgtgtgcatctttaatctttcaagccaaattacagctatttcaggtttcctgtgttagcttggggataggatggtggctggagacaggcaggcttctctgccctgggaagagcccactcagcttaattgctctgccatcgtagagcctggttggacttggcttcctgaaaactcccactgatagtgcctgttagatctcctgtttgtttcagttggcagaacatttactggccccaactgtggcatcatcctctcagcagtcttcctgtcacccgcctggcaggcagaaggagctgcagtcccacgtgggcctgcctgggggggtgggggctgcatggctgttgggtggcagtgtcagcacagggagggcttaagttggggatgtttgaccaggccacctcctgcaactgctgtttctcctgtccctcctatgcagggcttgcagcagcagcagtgtggccatctccatcccccaaagcacacttgctctctcaatatgtcctagttttcttcagccttttctggttcagttcccttgtcctgatctcatcctctctggtctcccaataactcacccttgggatgtgtttagagcgtgggaggtgcctttgagaactgcttgactccatgatctcctagaacaaaaccgccctgactttacagggggaacactcatgctgagctgagaaagcagagaagtggcgtgggagccagctgggggtgaagagcatttgggccagtcccgtggcccccttcagattcctcaagcaggattgttctgttctaaaaagctgttgcacagcattcgcaatgagatctttagttggcggattttctggaacatttgtttttcaacttgtcccgacattttttttctgtttctattctgagagagagatgatcaagttttaatttgggtataggttaaatggaagaagaaacagaacttcatggccaaagtagacctatagattttgattgggttctttgttaacagtagaatgcgatctttgccactgactgtagtattaataaggttttaatgtgagatattcctgcaaaccatcccatttctactgattgtaagtcagaatttcttttatccctttcaaatcagtttctacatgtttaagtgttcagggcttcatcagcatgagaagtttgtaattactgaaagtctgatttcattcaggacacattttttccttcatattttttctgtgaatttataggctaggaaggctattgaagcctcaattatgggtcttcattttgagatcgttttctatgagctgaactgaggatatcaatggttatctcaaaatcgtcttttaggagatccccaattgactcagagtttgaggagttagtatcacagaattagatttttttaaagcatttgtacgtttccattcccaaatatgtagctgtggttcttgaaaacacatcctacattgcatatgggcatagcagtttttgacccaggcagaataagttaatatttaattaaatattgctttgaagatggcgctctgggcatgagcatggggctccatgacttcccttctatccccatgagcccctcctccatccagcgacaagccatgggcatgcatacaatgcagcaagaccaacacaagagcaatattgaattgttcattctatctaaaattacatgtatataaaatatataatttatcttcctgcatttttgaagtataaagtcataaattgtacatatctgtaagctagtatatttgtttcactgtttgtaatatttaagaaatgctcattctttgtagaacaaaaatgtattaaatattttaaaaattgctctgtgatacttaatttttttccccaaaatttgtaatgtgttgcttctacataagttctctggaaatatctacaactaataggacacatgtaaatccttgaagacacatcctggaattcataccccacaaggacagtgtgtatacaaagtatttgcagagcatgacttttatatgtgtgggatatcaatgtgtatatttatatttaaagtgtatttattgttacaagtctattctctattatattttatttactctgcggttataaaaatcacccttgcatacaagtttctagttgccagtgatgttctggaaataatgggagatattacaataaagctacagttatgacaccctg

SEQ ID NO: 1904 - DNA, 1973 bp, Homo sapiens
acacaatcgggcttcctagccgctggcggacccgatggggcgtcctgcgagggttcggcgagggttctgccaggatagtagcattgcgcccaaggagtgagaggcacccggggctactggagccagaccctcaacccgccctagtgggaggcgaagaacaacgaaagcctcgtattcccatttctctaatggctaatgacattaaagtatcatttgtggaaaagattatctgtcctgcattaaactgcttttggactttcgtctaaaatcagttggaccggtttttgttggcaaagttttgcctgaagcttattccaacagatgccaagcggacctcgcgccgctctgcgttgggccagcccctcacagctggtttcttaccacgtattgcgcaagcggaatctatgcctgttacccacactccctgcgcccccgcaccccgctcctgtgcgcaagtcggaatataaaaccgcggaggagtgagctcttggggtgtccagttggttgccgcggcagtctctccgagcagcgcatttgtcttctaggctgcttggttcgtgcctccgagaaaggggtctcctgctgccagctaagtgtgggagaacttgtgcacgtatctcccctccgaatcccaacgatgggtaacgccagctttggctccaaggaacagaagctgctgaagcggttgcggcttctgcccgccctgcttatcctccgcgccttcaagccccacaggaagatcagagattaccgcgtcgtggtagtcggcaccgctggtgtggggaaaagtacgctgctgcacaagtgggcgagcggcaacttccgtcatgagtacctgccgaccattgaaaatacctactgccagttgctgggctgcagccacggtgtgctttccctgcacatcaccgacagcaagagtggcgacggcaaccgcgctctgcagcgccacgttatagcccggggccacgccttcgtcctggtctactcagtcaccaagaaggaaaccctggaagagctgaaggccttctatgagctgatctgcaagatcaaaggtaacaacctgcataagttccccatcgtgctggtgggcaataaaagtgatgacacccaccgggaggtggccctgaatgatggtgccacctgtgcgatggagtggaattgcgccttcatggagatttcagccaagaccgatgtgaatgtgcaggagctgttccacatgctgctgaattacaagaaaaagcccaccaccggcctccaggagcccgagaagaaatcccagatgcccaacaccactgagaagctgcttgacaagtgcataatcatgtgagccctgggccttaagagccagctcttcctatcctgtagcgtgtagaaaacgtggactcatttcactatgttacatgtacatggttgattttgtgctgttgtttggactgtaacatccatgttgtcaatacgtataccttgtaagtggataacttttctttttcccaggccagagaattcaaattgttaaaacattggcatttgaagaggagaacaaaatgtagcatgatgtatttaaagtaaggcctttagtaatgaatgtaatgagagaaaatgttttgaaaagaacaaaacatcaaaatgaatagaaagaaaaattggaaggcgtccttttggtaacccgattattgtgtattacctttaaatatttcacatcctgtaagtgcttaatcatatcttttaattgtgtatttaagaaaagtgttttcacaacaaaagcttttgataaattgctgcgtgacatatactaaataaaaaaatgaatatgttgatcattaggggtgtgggagcagagaaaattgtgaaagtgactctcactaaagatgttagtagtttctcatgtcatttaaaaatgtttgagtattctgcatagcagtttgtaaaagtgtaacagcttattgacttaataaagcttttcctgcatgcaa

SEQ ID NO: 1905 - DNA, 1629 bp, Homo sapiens
gctctgcgttgggccagcccctcacagctggtttcttaccacgtattgcgcaagcggaatctatgcctgttacccacactccctgcgcccccgcaccccgctcctgtgcgcaagtcggaatataaaaccgcggaggagtgagctcttggggtgtccagttggttgccgcggcagtctctccgagcagcgcatttgtcttctaggctgcttggttcgtgcctccgagaaaggggtctcctgctgccagctaagtgtgggagaacttgtgcacgtatctcccctccgaatcccaacgatgggtaacgccagctttggctccaaggaacagaagctgctgaagcggttgcggcttctgcccgccctgcttatcctccgcgccttcaagccccacaggaagatcagagattaccgcgtcgtggtagtcggcaccgctggtgtggggaaaagtacgctgctgcacaagtgggcgagcggcaacttccgtcatgagtacctgccgaccattgaaaatacctactgccagttgctgggctgcagccacggtgtgctttccctgcacatcaccgacagcaagagtggcgacggcaaccgcgctctgcagcgccacgttatagcccggggccacgccttcgtcctggtctactcagtcaccaagaaggaaaccctggaagagctgaaggccttctatgagctgatctgcaagatcaaaggtaacaacctgcataagttccccatcgtgctggtgggcaataaaagtgatgacacccaccgggaggtggccctgaatgatggtgccacctgtgcgatggagtggaattgcgccttcatggagatttcagccaagaccgatgtgaatgtgcaggagctgttccacatgctgctgaattacaagaaaaagcccaccaccggcctccaggagcccgagaagaaatcccagatgcccaacaccactgagaagctgcttgacaagtgcataatcatgtgagccctgggccttaagagccagctcttcctatcctgtagcgtgtagaaaacgtggactcatttcactatgttacatgtacatggttgattttgtgctgttgtttggactgtaacatccatgttgtcaatacgtataccttgtaagtggataacttttctttttcccaggccagagaattcaaattgttaaaacattggcatttgaagaggagaacaaaatgtagcatgatgtatttaaagtaaggcctttagtaatgaatgtaatgagagaaaatgttttgaaaagaacaaaacatcaaaatgaatagaaagaaaaattggaaggcgtccttttggtaacccgattattgtgtattacctttaaatatttcacatcctgtaagtgcttaatcatatcttttaattgtgtatttaagaaaagtgttttcacaacaaaagcttttgataaattgctgcgtgacatatactaaataaaaaaatgaatatgttgatcattaggggtgtgggagcagagaaaattgtgaaagtgactctcactaaagatgttagtagtttctcatgtcatttaaaaatgtttgagtattctgcatagcagtttgtaaaagtgtaacagcttattgacttaataaagcttttcctgcatgc

SEQ ID NO: 1906 - DNA, 580 bp, Homo sapiens
cctgggcctagattccccagctgctgttctctggagggagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttcta

SEQ ID NO: 1907 - DNA, 459 bp, Homo sapiens
agatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggag

SEQ ID NO: 1908 - DNA, 939 bp, Homo sapiens
ctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggcc

SEQ ID NO: 1909 - DNA, 515 bp, Homo sapiens
gtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggag

SEQ ID NO: 1910 - DNA, 1106 bp, Homo sapiens
gatcccagaagtaggaggggcgtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggcc

SEQ ID NO: 1911 - DNA, 515 bp, Homo sapiens; identical to SEQ ID NO: 1909

SEQ ID NO: 1912 - DNA, 1121 bp, Homo sapiens
gacgctcggacaaagccaggcagcgttggcagccccagacccgaccccaaaggcctgagactggggtgactgggacctaagagaatcctgagctggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggcc

SEQ ID NO: 1913 - DNA, 1118 bp, Homo sapiens
gaggaactgagaggagaaggagaagagagtgggcccgccttcagggtctggggccttccaggttgggtcgtaggggcgggagcgcacaggctgcgagagaggagcaaaggttggtggagggagaagagcagtctggggcctggctggacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggcc

SEQ ID NO: 1914 - DNA, 459 bp, Homo sapiens; identical to SEQ ID NO: 1907

SEQ ID NO: 1915 - DNA, 232 bp, Homo sapiens
agatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggt

SEQ ID NO: 1916 - DNA, 1093 bp, Homo sapiens
ggctttaggaagttatttaactgatctctgccctagtttcttcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggcc

SEQ ID NO: 1917 - DNA, 588 bp, Homo sapiens
ctgccggtgagcgccagcttcagggtcccacccccccatgcctggctcttggctgaacatttcttcccagcgcttccagcagccagaggcaggcgcccaagctcgctggctgttgctgagggcctgtagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggag

SEQ ID NO: 1918 - DNA, 758 bp, Homo sapiens
ggctttaggaagttatttaactgatctctgccctagtttcttcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggag

SEQ ID NO: 1919 - DNA, 485 bp, Homo sapiens
ggaagggagggagccgaggcgagggggaggcggcgcctgggcccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggt

SEQ ID NO: 1920 - DNA, 799 bp, Homo sapiens
ctgccggtgagcgccagcttcagggtcccacccccccatgcctggctcttggctgaacatttcttcccagcgcttccagcagccagaggcaggcgcccaagctcgctggctgttgctgagggcctgtagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacc

SEQ ID NO: 1921 - DNA, 873 bp, Homo sapiens
gggagccactgggactactgggtccgggagggggaagggagggctgcgagcccgaacgcgcggcgagaaggccgaggggagggaggggagcgaggagcgggaggaggaagggagggagccgaggcgagggggaggcggcgcctgggcccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggag

SEQ ID NO: 1922 - DNA, 459 bp, Homo sapiens; identical to SEQ ID NO: 1907

SEQ ID NO: 1923 - DNA, 459 bp, Homo sapiens; identical to SEQ ID NO: 1907

SEQ ID NO: 1924 - DNA, 140 bp, Homo sapiens
tctgaggccgtgtacctcaacgactccacctatgacggacataccgtgggcggactgcagtatgggggtctgggccagctggcagatggtgtggtggggctggatgactttaggaagagtcaggagctgcgggtctggcc

SEQ ID NO: 1925 - DNA, 560 bp, Homo sapiens
cgttggaacgtccttgggcttctgaactagtgcccatgtgtgcctcggcctttcccaagggccagcttcttcctgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctga

SEQ ID NO: 1926 - DNA, 459 bp, Homo sapiens; identical to SEQ ID NO: 1907

SEQ ID NO: 1927 - DNA, 886 bp, Homo sapiens
gtcagggacactgagaggtgggtgtgtgcatgccacatttagcctcgctgtttacagccagttcaagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggaggggtgagtggctcagcttcctgggaatctgtttcctgagcaggggactggagggtggggagtgtggagaatgggcatccaggatcccttctcctgctgggaagctgtcactctgaggagggggctagccagcattgtctcctccatgccaatgagccagtggagagatacaagaagggacctgaaacctgcccaggcctgatgcagggatggggga

SEQ ID NO: 1928 - DNA, 1979 bp, Homo sapiens
ggcagcgactgcgccccgtcccggcgccgcgctcgtccgcagaggaggcggcccggcccgggcagctgcggctcgggatccgtcgaggggaggccgagcttgccaagctggcgcccagcggggtcatggtgcccggcgcccgcggcggcggcgcactggcgcgggctgccgggcggggcctcctggctttgctgctcgcggtctccgccccgctccggctgcaggcggaggagctgggtgatggctgtggacacctagtgacttatcaggatagtggcacaatgacatctaagaattatcccgggacctaccccaatcacactgtttgcgaaaagacaattacagtaccaaaggggaaaagactgattctgaggttgggagatttggatatcgaatcccagacctgtgcttctgactatcttctcttcaccagctcttcagatcaatatggtccatactgtggaagtatgactgttcccaaagaactcttgttgaacacaagtgaagtaaccgtccgctttgagagtggatcccacatttctggccggggttttttgctgacctatgcgagcagcgaccatccagatttaataacatgtttggaacgagctagccattatttgaagacagaatacagcaaattctgcccagctggttgtagagacgtagcaggagacatttctgggaatatggtagatggatatagagatacctctttattgtgcaaagctgccatccatgcaggaataattgctgatgaactaggtggccagatcagtgtgcttcagcgcaaagggatcagtcgatatgaagggattctggccaatggtgttctttcgagggatggttccctgtcagacaagcgatttctgtttacctccaatggttgcagcagatccttgagttttgaacctgacgggcaaatcagagcttcttcctcatggcagtcggtcaatgagagtggagaccaagttcactggtctcctggccaagcccgacttcaggaccaaggcccatcatgggcttcgggcgacagtagcaacaaccacaaaccacgagagtggctggagatcgatttgggggagaaaaagaaaataacaggaattaggaccacaggatctacacagtcgaacttcaacttttatgttaagagttttgtgatgaacttcaaaaacaataattctaagtggaagacctataaaggaattgtgaataatgaagaaaaggtgtttcagggtaactctaactttcgggacccagtgcaaaacaatttcatccctcccatcgtggccagatatgtgcgggttgtcccccagacatggcaccagaggatagccttgaaggtggagctcattggttgccagattacacaaggtaatgattcattggtgtggcgcaagacaagtcaaagcaccagtgtttcaactaagaaagaagatgagacaatcacaaggcccatcccctcggaagaaacatccacaggaataaacattacaacggtggctattccattggtgctccttgttgtcctggtgtttgctggaatggggatctttgcagcctttagaaagaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcaggttaactccgttgactgccaaaatagcatccccaacgtgcagccctccgcatctatcagcaggttgccccggatggatctcagagatgaggattggaacaccatgttctttcccaccctaacaacaacaaagggcagtaaattaaagtactctttgtaaggtacagttaccgattaatctagagataaaatattttcttaaaaatatatttcattaaacacctatgctgtctctataaa

SEQ ID NO: 1929 - DNA, 3626 bp, Homo sapiens
cgactgcgccccgtcccggcgccgcgctcgtccgcagaggaggcggcccggcccgggcagctgcggctcgggatccgtcgaggggaggccgagcttgccaagctggcgcccagcggggtcatggtgcccggcgcccgcggcggcggcgcactggcgcgggctgccgggcggggcctcctggctttgctgctcgcggtctccgccccgctccggctgcaggcggaggagctgggtgatggctgtggacacctagtgacttatcaggatagtggcacaatgacatctaagaattatcccgggacctaccccaatcacactgtttgcgaaaagacaattacagtaccaaaggggaaaagactgattctgaggttgggagatttggatatcgaatcccagacctgtgcttctgactatcttctcttcaccagctcttcagatcaatatggtccatactgtggaagtatgactgttcccaaagaactcttgttgaacacaagtgaagtaaccgtccgctttgagagtggatcccacatttctggccggggttttttgctgacctatgcgagcagcgaccatccagatttaataacatgtttggaacgagctagccattatttgaagacagaatacagcaaattctgcccagctggttgtagagacgtagcaggagacatttctgggaatatggtagatggatatagagatacctctttattgtgcaaagctgccatccatgcaggaataattgctgatgaactaggtggccagatcagtgtgcttcagcgcaaagggatcagtcgatatgaagggattctggccaatggtgttctttcgagggatggttccctgtcagacaagcgatttctgtttacctccaatggttgcagcagatccttgagttttgaacctgacgggcaaatcagagcttcttcctcatggcagtcggtcaatgagagtggagaccaagttcactggtctcctggccaagcccgacttcaggaccaaggcccatcatgggcttcgggcgacagtagcaacaaccacaaaccacgagagtggctggagatcgatttgggggagaaaaagaaaataacaggaattaggaccacaggatctacacagtcgaacttcaacttttatgttaagagttttgtgatgaacttcaaaaacaataattctaagtggaagacctataaaggaattgtgaataatgaagaaaaggtgtttcagggtaactctaactttcgggacccagtgcaaaacaatttcatccctcccatcgtggccagatatgtgcgggttgtcccccagacatggcaccagaggatagccttgaaggtggagctcattggttgccagattacacaaggtaatgattcattggtgtggcgcaagacaagtcaaagcaccagtgtttcaactaagaaagaagatgagacaatcacaaggcccatcccctcggaagaaacatccacaggaataaacattacaacggtggctattccattggtgctccttgttgtcctggtgtttgctggaatggggatctttgcagcctttagaaagaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcagattaccagcagcccctcatgattggcaccgggacagtcacgaggaagggctccaccttccggcccatggacacggatgccgaggaggcaggggtgagcaccgatgccggcggccactatgactgcccgcagcgggccggccgccacgagtacgcgctgcccctggcgcccccggagcccgagtacgccacgcccatcgtggagcggcacgtgctgcgcgcccacacgttctctgcgcagagcggctaccgcgtcccagggccccagcccggccacaaacactccctctcctcgggcggcttctcccccgtagcgggtgtgggcgcccaggacggagactatcaaaggccacacagcgcacagcctgcggacaggggctacgaccggcccaaagctgtcagcgccctcgccaccgaaagcgggcaccctgactctcagaagcccccaacgcatcccgggacgagtgacagctattctgcccccagagactgcctcacacccctcaaccagacggccatgactgcccttttgtgaacacaatgtgaaagaagcctgctgtggtactgagcgtcgggctgtcacaaggcactggaagaagggagcctgctggtccagagtgtgcgtgtgtatcggtgtgtgtgtacacttgcatgtgtgtgtgtgatccagtaggatcctagagacaacctgtcatactgtttacaaaattgtgcagctggtttcgtgctgacccttagggtgcgtctgttgggttttgttgggctagaaaaatgaaaattttcagatggcgttttcattcctctgactgatattgagctgctttggtgttaaaggtgtaatgtgtacagagttgtatttaacaataataaaagtaacttaagtttgctctatcagattttagttctgcacagaggttaagtgggaaaatgcagctgttgcaaaatgtatataaatagtatgttcatttttttcagtatattatctgatactgtgttagcagcaggtctgcttaaacctagtcttgttgttattgagtcatttcctctcctttgataactagaactgaaagcatttttaacattcttctcctggaagaaatgaattacttgaagcatgaaaagcacaccagggtggttgtttatttagcaattatgactgtagatttaaaaacaagcaaagaaacaacacctcagcagctgcccgtttccttagtctccacttcagagggggatgcgaagaggtcggcccagctccggtgaccatgaaggtggcacaggaattacagtgtgaatggctgtgtcagatgttttcgtacctcagattaaaaatattgctgaggtcagacgccacaattttcatgactttcttcagaagtagcacattttcgtgacttccgctgtcctctgaaaaacaaagttatttggaacatgttcatgcaaaagtgattctgaccaagtctaaatcgagcttttctactgacatgaaactgttggaaactgatctcattttataagaaatgattttcccctcaaggaggcgtctgtaattccagaacagtccagacatcagctgtacctcatgctcagtagtttttatttgagtttcttttgtgagttaactatgggagatttaacctcttttgccaaagagggaagtgtgtgtgtttttttaatagaaaatatggaccaaaaatttttttccctgaagaatgtattataaccctatttgtgtggttattacatcctgtgaaatgtatatatgttaaaataatgggggtgctggaaggtcatggcagactagctgctggttagtgtggaggggaaatggtttactttgtagagtttacatggttttatgcgcacactaattgtaataaactatgccaaaccaaa

SEQ ID NO: 1930 - DNA, 1676 bp, Homo sapiens
ggcagcgactgcgccccgtcccggcgccgcgctcgtccgcagaggaggcggcccggcccgggcagctgcggctcgggatccgtcgaggggaggccgagcttgccaagctggcgcccagcggggtcatggtgcccggcgcccgcggcggcggcgcactggcgcgggctgccgggcggggcctcctggctttgctgctcgcggtctccgccccgctccggctgcaggcggaggagctgggtgatggctgtggacacctagtgacttatcaggatagtggcacaatgacatctaagaattatcccgggacctaccccaatcacactgtttgcgaaaagacaattacagtaccaaaggggaaaagactgattctgaggttgggagatttggatatcgaatcccagacctgtgcttctgactatcttctcttcaccagctcttcagatcaatatggtccatactgtggaagtatgactgttcccaaagaactcttgttgaacacaagtgaagtaaccgtccgctttgagagtggatcccacatttctggccggggttttttgctgacctatgcgagcagcgaccatccagatttaataacatgtttggaacgagctagccattatttgaagacagaatacagcaaattctgcccagctggttgtagagacgtagcaggagacatttctgggaatatggtagatggatatagagatacctctttattgtgcaaagctgccatccatgcaggaataattgctgatgaactaggtggccagatcagtgtgcttcagcgcaaagggatcagtcgatatgaagggattctggccaatggtgttctttcgagggatggttccctgtcagacaagcgatttctgtttacctccaatggaataaacattacaacggtggctattccattggtgctccttgttgtcctggtgtttgctggaatggggatctttgcagcctttagaaagaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcagattaccagcagcccctcatgattggcaccgggacagtcacgaggaagggctccaccttccggcccatggacacggatgccgaggaggcaggggtgagcaccgatgccggcggccactatgactgcccgcagcgggccggccgccacgagtacgcgctgcccctggcgcccccggagcccgagtacgccacgcccatcgtggagcggcacgtgctgcgcgcccacacgttctctgcgcagagcggctaccgcgtcccagggccccagcccggccacaaacactccctctcctcgggcggcttctcccccgtagcgggtgtgggcgcccaggacggagactatcaaaggccacacagcgcacagcctgcggacaggggctacgaccggcccaaagctgtcagcgccctcgccaccgaaagcgggcaccctgactctcagaagcccccaacgcatcccgggacgagtgacagctattctgcccccagagactgcctcacacccctcaaccagacggccatgactgcccttttgtga

SEQ ID NO: 1931 - DNA, 1778 bp, Homo sapiens
ggcagcgactgcgccccgtcccggcgccgcgctcgtccgcagaggaggcggcccggcccgggcagctgcggctcgggatccgtcgaggggaggccgagcttgccaagctggcgcccagcggggtcatggtgcccggcgcccgcggcggcggcgcactggcgcgggctgccgggcggggcctcctggctttgctgctcgcggtctccgccccgctccggctgcaggcggaggagctgggtgatggctgtggacacctagtgacttatcaggatagtggcacaatgacatctaagaattatcccgggacctaccccaatcacactgtttgcgaaaagacaattacagtaccaaaggggaaaagactgattctgaggttgggagatttggatatcgaatcccagacctgtgcttctgactatcttctcttcaccagctcttcagatcaatatggtccatactgtggaagtatgactgttcccaaagaactcttgttgaacacaagtgaagtaaccgtccgctttgagagtggatcccacatttctggccggggttttttgctgacctatgcgagcagcgaccatccagatttaataacatgtttggaacgagctagccattatttgaagacagaatacagcaaattctgcccagctggttgtagagacgtagcaggagacatttctgggaatatggtagatggatatagagatacctctttattgtgcaaagctgccatccatgcaggaataattgctgatgaactaggtggccagatcagtgtgcttcagcgcaaagggatcagtcgatatgaagggattctggccaatggtgttctttcgagggatggttccctgtcagacaagcgatttctgtttacctccaatggttgcagcagatccttgagttttgaacctgacgggcaaatcagagcttcttcctcatggcagtcggtcaatgagagtggagaccaagttcactggtctcctggccaagcccgacttcaggaccaaggcccatcatgggcttcgggcgacagtagcaacaaccacaaaccacgagagtggctggagatcgatttgggggagaaaaagaaaataacaggaattaggaccacaggatctacacagtcgaacttcaacttttatgttaagagttttgtgatgaacttcaaaaacaataattctaagtggaagacctataaaggaattgtgaataatgaagaaaaggtgtttcagggtaactctaactttcgggacccagtgcaaaacaatttcatccctcccatcgtggccagatatgtgcgggttgtcccccagacatggcaccagaggatagccttgaaggtggagctcattggttgccagattacacaaggtaatgattcattggtgtggcgcaagacaagtcaaagcaccagtgtttcaactaagaaagaagatgagacaatcacaaggcccatcccctcggaagaaacatccacaggaataaacattacaacggtggctattccattggtgctccttgttgtcctggtgtttgctggaatggggatctttgcagcctttagaaagaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcagcttctccagagccagtttcagagccacttcctccctga

SEQ ID NO: 1932 - DNA, 6122 bp, Homo sapiens
gcctgccagctagccggagccgcgggtgagcgcggcgagcggcgaccctggtgaggagcgcggcgcgggaggcacgttccttagctccgccgcggccgtcctccgcggctcgaggactccgcttccttccctcccctcccctgcgctccggcctggggtctcggcgcggggagcggagggaagggacgaaggaggagtaggtgaaagcggggtgaggggcggaagggtcccggcgcggggtgaggcgagggctgcctcttgttctcccgccgctgccgccgtctcctggtcgggtgccgcggccagaggcgcgcggggctgccgaggcacccgcactatgcaggcagactgccggccgccgcgatggcgagccgggcggtggtgagagccaggcgctgcccgcagtgtccccaagtccgggccgcggccgccgcccccgcctgggccgcgctccccctctcccgctccctccctccctgctccaactcctcctccttctccatgcctctgttcctcctgctcttacttgtcctgctcctgctgctcgaggacgctggagcccagcaaggtgatggatgtggacacactgtactaggccctgagagtggaacccttacatccataaactacccacagacctatcccaacagcactgtttgtgaatgggagatccgtgtaaagatgggagagagagttcgcatcaaatttggtgactttgacattgaagattctgattcttgtcactttaattacttgagaatttataatggaattggagtcagcagaactgaaataggcaaatactgtggtctggggttgcaaatgaaccattcaattgaatcaaaaggcaatgaaatcacattgctgttcatgagtggaatccatgtttctggacgcggatttttggcctcatactctgttatagataaacaagatctaattacttgtttggacactgcatccaattttttggaacctgagttcagtaagtactgcccagctggttgtctgcttccttttgctgagatatctggaacaattcctcatggatatagagattcctcgccattgtgcatggctggtgtgcatgcaggagtagtgtcaaacacgttgggcggccaaatcagtgttgtaattagtaaaggtatcccctattatgaaagttctttggctaacaacgtcacatctgtggtgggacacttatctacaagtctttttacatttaagacaagtggatgttatggaacactggggatggagtctggtgtgatcgcggatcctcaaataacagcatcatctgtgctggagtggactgaccacacagggcaagagaacagttggaaacccaaaaaagccaggctgaaaaaacctggaccgccttgggctgcttttgccactgatgaataccagtggttacaaatagatttgaataaggaaaagaaaataacaggcattataaccactggatccaccatggtggagcacaattactatgtgtctgcctacagaatcctgtacagtgatgatgggcagaaatggactgtgtacagagagcctggtgtggagcaagataagatatttcaaggaaacaaagattatcaccaggatgtgcgtaataactttttgccaccaattattgcacgttttattagagtgaatcctacccaatggcagcagaaaattgccatgaaaatggagctgctcggatgtcagtttattcctaaaggtcgtcctccaaaacttactcaacctccacctcctcggaacagcaatgacctcaaaaacactacagcccctccaaaaatagccaaaggtcgtgccccaaaatttacgcaaccactacaacctcgcagtagcaatgaatttcctgcacagacagaacaaacaactgccagtcctgatatcagaaatactaccgtaactccaaatgtaaccaaagatgtagcgctggctgcagttcttgtccctgtgctggtcatggtcctcactactctcattctcatattagtgtgtgcttggcactggagaaacagaaagaaaaaaactgaaggcacctatgacttaccttactgggaccgggcaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttgaagatgatgctgctttttacaaagcatcgttttaaagcacatggccttttttttttaattattagtggtagtaatatatagaatgtattacataactgtcactgaagtggttggggaaaatgtggtgactgaggtacaggaaactactaatcttgccatcttgctttaaggtgttatggtggcacagttactgctcgcctgttaaatttcaaatgtcctgtttgatactactgtagaacactatttttaatacagaaaaagctccctataatgcacttcagagaaattaaaaatcacagagtatttattaccaatgctgcaggtacattaatgaactcgagatggctctgtaagcctgactggcaataacgcacggtactgttcttgaaatacctaatggcttgaaattctagtctgtttgtgaaagatgggtactatcatgatttcctcttctattcctatattcttttctggattttttttaataattagtgatataagcattgtttttattgcagccatatccacttatccatcttaagatctgtagctgggattttctgacttgtaatgagcagggggattgctttttcactttgtgacactctttagagctttaatgcttcacagtatatggcctggtctcatccttgcgtgttccacttgaggccctttggtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttactagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctattttttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaattctgacttatactttattaaatgctgtaaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaagtcaactgtggcaccaattctaatgtaatccaacttgtgactgtttttttttgttttgttttgtttttgtgtgtgtgtgtgtggcactgggaaaagtggaaacaaacatgtattgaaatacatattggaaataaaaatggtttgagcgtcagtgatattctcccagaatgtacttatcttacctcggcatgtactgtagtcactcagtatttgtatatgttgctagaatttagattgtaaaatagtgaaattttaatgtgttcatttgtttttaatgtatatatgtcttgctcagattatttggtttaaataaaacaaccttgaggtttgtagcttttccttatactataaaatgccagattcttctattttaacctca

SEQ ID NO: 1933 - DNA, 3959 bp, Homo sapiens
atggcgagccgggcggtggtgagagccaggcgctgcccgcagtgtccccaagtccgggccgcggccgccgcccccgcctgggccgcgctccccctctcccgctccctccctccctgctccaactcctcctccttctccatgcctctgttcctcctgctcttacttgtcctgctcctgctgctcgaggacgctggagcccagcaaggtgatggatgtggacacactgtactaggccctgagagtggaacccttacatccataaactacccacagacctatcccaacagcactgtttgtgaatgggagatccgtgtaaagatgggagagagagttcgcatcaaatttggtgactttgacattgaagattctgattcttgtcactttaattacttgagaatttataatggaattggagtcagcagaactgaaataggcaaatactgtggtctggggttgcaaatgaaccattcaattgaatcaaaaggcaatgaaatcacattgctgttcatgagtggaatccatgtttctggacgcggatttttggcctcatactctgttatagataaacaagatctaattacttgtttggacactgcatccaattttttggaacctgagttcagtaagtactgcccagctggttgtctgcttccttttgctgagatatctggaacaattcctcatggatatagagattcctcgccattgtgcatggctggtgtgcatgcaggagtagtgtcaaacacgttgggcggccaaatcagtgttgtaattagtaaaggtatcccctattatgaaagttctttggctaacaacgtcacatctgtggtgggacacttatctacaagtctttttacatttaagacaagtggatgttatggaacactggggatggagtctggtgtgatcgcggatcctcaaataacagcatcatctgtgctggagtggactgaccacacagggcaagagaacagttggaaacccaaaaaagccaggctgaaaaaacctggaccgccttgggctgcttttgccactgatgaataccagtggttacaaatagatttgaataaggaaaagaaaataacaggcattataaccactggatccaccatggtggagcacaattactatgtgtctgcctacagaatcctgtacagtgatgatgggcagaaatggactgtgtacagagagcctggtgtggagcaagataagatatttcaaggaaacaaagattatcaccaggatgtgcgtaataactttttgccaccaattattgcacgttttattagagtgaatcctacccaatggcagcagaaaattgccatgaaaatggagctgctcggatgtcagtttattcctaaaggtcgtcctccaaaacttactcaacctccacctcctcggaacagcaatgacctcaaaaacactacagcccctccaaaaatagccaaaggtcgtgccccaaaatttacgcaaccactacaacctcgcagtagcaatgaatttcctgcacagacagaacaaacaactgccagtcctgatatcagaaatactaccgtaactccaaatgtaaccaaagatgtagcgctggctgcagttcttgtccctgtgctggtcatggtcctcactactctcattctcatattagtgtgtgcttggcactggagaaacagaaagaaaaaaactgaaggcacctatgacttaccttactgggaccgggcaggtttttatttaatggtctctttggcttgccgtcacaatgaaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttgaagatgatgctgctttttacaaagcatcgttttaaagcacatggccttttttttttaattattagtggtagtaatatatagaatgtattacataactgtcactgaagtggttggggaaaatgtggtgactgaggtacaggaaactactaatcttgccatcttgctttaaggtgttatggtggcacagttactgctcgcctgttaaatttcaaatgtcctgtttgatactactgtagaacactatttttaatacagaaaaagctccctataatgcacttcagagaaattaaaaatcacagagtatttattaccaatgctgcaggtacattaatgaactcgagatggctctgtaagcctgactggcaataacgcacggtactgttcttgaaatacctaatggcttgaaattctagtctgtttgtgaaagatgggtactatcatgatttcctcttctattcctatattcttttctggattttttttaataattagtgatataagcattgtttttattgcagccatatccacttatccatcttaagatctgtagctgggattttctgacttgtaatgagcagggggattgctttttcactttgtgacactctttagagctttaatgcttcacagtatatggcctggtctcatccttgcgtgttccacttgaggccctttggtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttactagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagta

SEQ ID NO: 1934 - DNA, 6078 bp, Homo sapiens
gcctgccagctagccggagccgcgggtgagcgcggcgagcggcgaccctggtgaggagcgcggcgcgggaggcacgttccttagctccgccgcggccgtcctccgcggctcgaggactccgcttccttccctcccctcccctgcgctccggcctggggtctcggcgcggggagcggagggaagggacgaaggaggagtaggtgaaagcggggtgaggggcggaagggtcccggcgcggggtgaggcgagggctgcctcttgttctcccgccgctgccgccgtctcctggtcgggtgccgcggccagaggcgcgcggggctgccgaggcacccgcactatgcaggcagactgccggccgccgcgatggcgagccgggcggtggtgagagccaggcgctgcccgcagtgtccccaagtccgggccgcggccgccgcccccgcctgggccgcgctccccctctcccgctccctccctccctgctccaactcctcctccttctccatgcctctgttcctcctgctcttacttgtcctgctcctgctgctcgaggacgctggagcccagcaaggtgatggatgtggacacactgtactaggccctgagagtggaacccttacatccataaactacccacagacctatcccaacagcactgtttgtgaatgggagatccgtgtaaagatgggagagagagttcgcatcaaatttggtgactttgacattgaagattctgattcttgtcactttaattacttgagaatttataatggaattggagtcagcagaactgaaataggcaaatactgtggtctggggttgcaaatgaaccattcaattgaatcaaaaggcaatgaaatcacattgctgttcatgagtggaatccatgtttctggacgcggatttttggcctcatactctgttatagataaacaaggatctaattacttgtttggacactgcatccaattttggaacctgagttcaggtaagtactgcccagctggttgtctgcttccttttgctgagatatctggaacaattcctcatggatatagagattcctcgccattgtgcatggctggtgtgcatgcaggagtagtgtcaaacacgttgggcggccaaatcagtgttgtaattagtaaaggtatcccctattatgaaagttctttggctaacaacgtcacatctgtggtgtcagtatcactgttaatggtgttcattcttttctttgtttcaggatgttatggaacactggggatggagtctggtgatcgcggatcctcaaataacagcatcgtgctggagtggactgaccacacagggcaagagaacagttggaaacccaaaaaacaggctgaaaaaacctggaccgccttgggctttgccactgatgaataccagtggttacaaatagatttgaataaggaaaagaaaataacaggcattataaccactggatccaccatggtgacaattactatgtgtctgcctacagaatcctgtacagtgatgatgggcagaaatggactgtgtacagagagcctggtggagcaagataagatatttcaaggaaacaaagattatcaccaggatgtgcgtaataactttttgccaccaattattgcacgttttattagagtgaatcctacccaatggcagcagaaaattgccatgaaaatggagctgctcggatgtcagtttattcctaaaggtcgtcctccaaaacttactcaacctccacctcctcggaacagcaatgacctcaaaaacactacagcccctccaaaaatagccaaaggtcgtgccccaaaatttacgcaaccactacaacctcgcagtagcaatgaatttcctgcacagacagaacaaacaactgccagtcctgatatcagaaatactaccgtaactccaaatgtaaccaaagatgtagcgctggctgcagttcttgtccctgtgctggtcatggtcctcactactctcattctcatattagtgtgtgcttggcactggagaaacagaaagaaaaaaactgaaggcacctatgacttaccttactgggaccgggcaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttgaagatgatgctgctttttacaaagcatcgttttaaagcacatggccttttttttttaattattagtggtagtaatatatagaatgtattacataactgtcactgaagtggttggggaaaatgtggtgactgaggtacaggaaactactaatcttgccatcttgctttaaggtgttatggtggcacagttactgctcgcctgttaaatttcaaatgtcctgtttgatactactgtagaacactatttttaatacagaaaaagctccctataatgcacttcagagaaattaaaaatcacagagtatttattaccaatgctgcaggtacattaatgaactcgagatggctctgtaagcctgactggcaataacgcacggtactgttcttgaaatacctaatggcttgaaattctagtctgtttgtgaaagatgggtactatcatgatttcctcttctattcctatattcttttctggattttttttaataattagtgatataagcattgtttttattgcagccatatccacttatccatcttaagatctgtagctgggattttctgacttgtaatgagcagggggattgctttttcactttgtgacactctttagagctttaatgcttcacagtatatggcctggtctcatccttgcgtgttccacttgaggccctttggtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttactagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctattttttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaattctgacttatactttattaaatgctgtaaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaagtcaactgtggcaccaattctaatgtaatccaacttgtgactgtttttttttgttttgttttgtttttgtgtgtgtgtgtgtggcactgggaaaagtggaaacaaacatgtattgaaatacatattggaaataaaaatggtttgagcgtcagtgatattctcccagaatgtacttatcttacctcggcatgtactgtagtcactcagtatttgtatatgttgctagaatttagattgtaaaatagtgaaattttaatgtgttcatttgtttttaatgtatatatgtcttgctcagattatttggtttaaataaaacaaccttgaggtttgtagcttttccttatactata

SEQ ID NO: 1935 - DNA, 2188 bp, Homo sapiens
agctgagatgaataatgaacttaattttccataaagacattctgtttggcattccagctaataaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggtagaacaatgtagattttgtatggttcatttaaaaacctgcacaaacactggacagtctaaataggcttctgcattcagtcctgctgtttacaatgtgaaatggagctgatatcatattaatttcattgtaatgacaatgtttacatagtaatcatttgggatattatctgtaatatgtttcaggcatatttttaaagaaaaacctgtctttgtgaattggaaaatgggaatgtggctttttttgttaattaaactttaagttaaaccattttagtcactggaaggaactgcctccattttgctttttaaactaaaataaatgacatcttcagtgcatgaatccatagaacaaga

SEQ ID NO: 1936 - DNA, 5332 bp, Homo sapiens
ggtagaagtggagagagagagacagagggagcgagagagagagcaagacagaccgagaaggaaagcactcccagagatgaaattttaggaaagcaaaatgatcgacctttttaaggctgagtgggtttcttcagtttgtgtgcaagtttcaagaaatggaaggactgaccaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacgggtgtcataaaactgagttctgcagttgaagtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccctttattttctgggcaaagccaaacccacctgtgtagaagtgatgcctttaggtcacccgccgtcctcagttctctcgagctagtctgttcagcaatataaaaccatagggtatttcagaaatccagtatcacagggtgatcctttgggacttaccgtcttccacgtgaaagaaactaggcctccgattccctttatttcccctaaatggttattcttttaaaaaagcagatggagcactttattcccaacctcagaaatcacaccatctcactggaatccatgagggacacagagagaggggaccaagcctggcctgggggtgggggacctggatgtgtagcaaggatgggagaagcgaaatctgcaggtgctgggggcacctgcacactcacagctgcacaaactgcctcactgttacttcatcaatcacagcttcaaatgtctcaatcagcagaagattgtaaattcgatctttcagggaaattaatctattctgaaaggcaataacatgaagcaaggcaaaggaggcactgatggtttagtatactacataagggatttttttgttctattattaagaaaatctagacctgaaatgttttctcaactcttattgtactgtgtatatttatattgttgtcgtggcggctgtttttaaagggaaagtgttggttctattaatttgttaagtgtccatccaggtgggcctacctgattccacatatataagtacatatctgcttataaagcgctgtaaatggcagcaaggctgtttttggagaagagtttgggttttcctaccatccctttgaatgctacacatccgtctattttaacccaagtagttcgtatttcagatatattttctcctttcatctcctctcactactgcagagtccagtaatacctagcataggattctgtcctgtgtcaaatggctaaaataaatttttgccccaatagacatgctgcctcattcaaaagagctgccgctgtcatcttgaggttccaggtagtgagagaagaaactcgacctgccagggtcaacagccatgaagaggtggggggagtcatgattcataaacactgaaagaagtcaaggcttttggcagagagtgttgatttagatttttagtcttgattgatgggcagtatgcatcggtgtctagctgaagttgtctttaaatgcccttactcgtcacagtttaaacacttaggatgtggcaatcttaagtatcaatggcattttatgtccagctaacatcctaaagcattagaaattaaaaacgaaagacttttaaaaacatacatcaaacatgcttgcaccagagaagctttttaaaataatacactctcatagccaggtgctaatttaattttacttatgaaattaagagaggtgatgggttctagcaacagatattttcacggacatattctaaaaccactagagaattcgctacctctcagagccatcgatgctttgagctacctttataaacagggcacaaatgtttactgctgtggtttacaagaaaagggctactcacttattttgaaaccaacgaaccaacttttaactagggtgaacaaagcactcaaagtgctttgtgaaattggagcatacagagattttgagcttcaagtatttgctagttttaaaaagaatacaccttttctttaccttgtagcagcaattaaaagtcacacaaagcttgcatcgagtagggccaactgccacttgggtagcctatggtcacattcaatactgagaatgacttggaactcacagattaatatgaaagaagcagcgttcatcccaagacccatgctcacaattacagctccgtgccctgaggtagagttgagatttggattaagaaatagatttctaatacgactcaagatcatcctacaatattttctttggaaactaatttagcccatgatattttaaagagagacaagagaaggcctatttatcttgtctaagtgaacggcatttgtatattcataagctatttttggtaagaattttaaatcttttagctcaaggcctacagggcatcatgatctttgccttccttgaaaatacaatttaaattgtacaaacactttataaaaagctaattattggtgttagaacatgaccccacacaatgctgcttgacccctgaaactgacattcatgagcataacctttgttacattgttctttttgatgtaatttgtagaaatgttttttagttcgtaatggaaaatgtatgtaccctgaaaaattacttattttgtttaactttggtataaaggtgttgggcattttcttggggagggggggattacaaaagaagtttgtctcccacatcaaaaaacgttcaaagaaattaagtatttattatattttttgcagatgtttccatacaattcacataacctttttgtaaagagagatgaagaaatggattaaagatttttaatatttgaaatggtaaatagaactaatttattgtaatatatttctgttatttatagatgtttccttaatgttttactgtgcattaccactttcatttaagccttatccttgtgaatttaccatttcttttttaaaacatgtctagatgcatattttaaataactggaatgtaaatcactagcatatctgaattcccaaatgtaatttttaaaaattattttggtttggaaaaaaaagattcatttgaaagccttcagatggaggggtgggaacatttttatggctttatgaattggaatttcataggcttatttacctagattgtgtgtgaacaaaaaaatattgtaaatagatgaatgtttcccataatgtaaaaagaagaaattaataaaataattaatgcactgct

SEQ ID NO: 1937 - DNA, 5257 bp, Homo sapiens
agacagaccgagaaggaaagcactcccagagatgaaattttaggaaagcaaaatgatcgacctttttaaggctgagtgggtttcttcagtttgtgtgcaagtttcaagaaatggaaggactgaccaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccctttattttctgggcaaagccaaacccacctgtgtagaagtgatgcctttaggtcacccgccgtcctcagttctctcgagctagtctgttcagcaatataaaaccatagggtatttcagaaatccagtatcacagggtgatcctttgggacttaccgtcttccacgtgaaagaaactaggcctccgattccctttatttcccctaaatggttattcttttaaaaaagcagatggagcactttattcccaacctcagaaatcacaccatctcactggaatccatgagggacacagagagaggggaccaagcctggcctgggggtgggggacctggatgtgtagcaaggatgggagaagcgaaatctgcaggtgctgggggcacctgcacactcacagctgcacaaactgcctcactgttacttcatcaatcacagcttcaaatgtctcaatcagcagaagattgtaaattcgatctttcagggaaattaatctattctgaaaggcaataacatgaagcaaggcaaaggaggcactgatggtttagtatactacataagggatttttttgttctattattaagaaaatctagacctgaaatgttttctcaactcttattgtactgtgtatatttatattgttgtcgtggcggctgtttttaaagggaaagtgttggttctattaatttgttaagtgtccatccaggtgggcctacctgattccacatatataagtacatatctgcttataaagcgctgtaaatggcagcaaggctgtttttggagaagagtttgggttttcctaccatccctttgaatgctacacatccgtctattttaacccaagtagttcgtatttcagatatattttctcctttcatctcctctcactactgcagagtccagtaatacctagcataggattctgtcctgtgtcaaatggctaaaataaatttttgccccaatagacatgctgcctcattcaaaagagctgccgctgtcatcttgaggttccaggtagtgagagaagaaactcgacctgccagggtcaacagccatgaagaggtggggggagtcatgattcataaacactgaaagaagtcaaggcttttggcagagagtgttgatttagatttttagtcttgattgatgggcagtatgcatcggtgtctagctgaagttgtctttaaatgcccttactcgtcacagtttaaacacttaggatgtggcaatcttaagtatcaatggcattttatgtccagctaacatcctaaagcattagaaattaaaaacgaaagacttttaaaaacatacatcaaacatgcttgcaccagagaagctttttaaaataatacactctcatagccaggtgctaatttaattttacttatgaaattaagagaggtgatgggttctagcaacagatattttcacggacatattctaaaaccactagagaattcgctacctctcagagccatcgatgctttgagctacctttataaacagggcacaaatgtttactgctgtggtttacaagaaaagggctactcacttattttgaaaccaacgaaccaacttttaactagggtgaacaaagcactcaaagtgctttgtgaaattggagcatacagagattttgagcttcaagtatttgctagttttaaaaagaatacaccttttctttaccttgtagcagcaattaaaagtcacacaaagcttgcatcgagtagggccaactgccacttgggtagcctatggtcacattcaatactgagaatgacttggaactcacagattaatatgaaagaagcagcgttcatcccaagacccatgctcacaattacagctccgtgccctgaggtagagttgagatttggattaagaaatagatttctaatacgactcaagatcatcctacaatattttctttggaaactaatttagcccatgatattttaaagagagacaagagaaggcctatttatcttgtctaagtgaacggcatttgtatattcataagctatttttggtaagaattttaaatcttttagctcaaggcctacagggcatcatgatctttgccttccttgaaaatacaatttaaattgtacaaacactttataaaaagctaattattggtgttagaacatgaccccacacaatgctgcttgacccctgaaactgacattcatgagcataacctttgttacattgttctttttgatgtaatttgtagaaatgttttttagttcgtaatggaaaatgtatgtaccctgaaaaattacttattttgtttaactttggtataaaggtgttgggcattttcttggggagggggggattacaaaagaagtttgtctcccacatcaaaaaacgttcaaagaaattaagtatttattatattttttgcagatgtttccatacaattcacataacctttttgtaaagagagatgaagaaatggattaaagatttttaatatttgaaatggtaaatagaactaatttattgtaatatatttctgttatttatagatgtttccttaatgttttactgtgcattaccactttcatttaagccttatccttgtgaatttaccatttcttttttaaaacatgtctagatgcatattttaaataactggaatgtaaatcactagcatatctgaattcccaaatgtaatttttaaaaattattttggtttggaaaaaaaagattcatttgaaagccttcagatggaggggtgggaacatttttatggctttatgaattggaatttcataggcttatttacctagattgtgtgtgaacaaaaaaatattgtaaatagatgaatgtttcccataatgtaaaaagaagaaattaataaaataattaatgcactgct

SEQ ID NO: 1938 - DNA, 3525 bp, Homo sapiens
agcctccgctccagaggcgagcgctgcgcttcgggcgccgcaatctccaggacacggcctcgcggacaccttccgcctcggggaatcggcagcataggcggcgcgaacggccgccgccgcctcggctcctctctcgagtccttcccgtcacctcgctgagagccggtcctggtcgcggggacatctctctccttcctccgaggctcgtgggaccaacggacggacgcagccagcgagggccggactgcgggacgcggccagagcagttgaacatcagatacccagagtgacatcaggttaaaaaaaagcctgcaatttggatcttttcctgactcggaagcaaggaaaatggacaattgataatcaaaggctaaatctcttctgggatccactgaatgccactagagggtctgctcgagagaattcctgattgaatgacaacggcgctaagaacaatccctgcccaagacgggtctggagcctgacttccgggtgtccatgaccctggcggctgcttccggtccgccatgaaagggctatcaggcagccgcagccatcaccacggggtcacctgcgactcggcctgtgactcgctgtcgcaccactccgaccgcaagccctacctgctgagcccagtggagcaccaccccgcagaccacccatactacacccagcggaactccttccaggctgagtgcgtgggccccttcagcgacccgctggccagcagcaccttcccccgcaggcactacacctcgcagcaagagctgaaggacgagtgtgccctggtgccccgcaccctggccaccaaggcgaaccgcatccccgccaacctgctggaccagttcgagcggcagctgccactcagccgcgatggctatcacaccctgcagtacaagcgcacggccgtggagcaccgcagcgacagccccggccgcatccgccacctggtgcactcggtccagaagctcttcaccaagtcgcactccctggaggggccgtccaagggcagcgtcaacgggggcaaggccagccctgacgaggcgcaggcggcgcgctatggcaaacgcagcaagagcaaggagcggcgcgcggagcccaaggcccggcccagcacctccccgggctggtggagctcggacgacaacctggatggtgacatgtgcatctaccacgccccctcgggcgtgatgaccatgggcaggtgccccgaccgctcggcctcacagtacttcctggaggcctacaacaccatcagcgagcaggcggtgaaggcctcccggagcaacaacgacgtcaagtgctccacctgcgccaacctgccggtcagcctggacaccccgctgctgaagaagagcgcctggtcctccacgctcaccgtgagccgggcccgggaggtttaccagaaggcctcggtgaacatggaccaggccatggtgaagtccgagtcgtgtcagcaagaacgctcctgccagtacctgcaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggtagaacaatgtagattttgtatggttcatttaaaaacctgcacaaacactggacagtctaaataggcttctgcattcagtcctgctgtttacaatgtgaaatggagctgatatcatattaatttcattgtaatgacaatgtttacatagtaatcatttgggatattatctgtaatatgtttcaggcatatttttaaagaaaaacctgtctttgtgaattggaaaatgggaatgtggctttttttgttaattaaactttaagttaaaccatttt

SEQ ID NO: 1939 - DNA, 6154 bp, Homo sapiens
tgcccaagacgggtctggagcctgacttccgggtgtccatgaccctggcggctgcttccggtccgccatgaaagggctatcaggcagccgcagccatcaccacggggtcacctgcgactcggcctgtgactcgctgtcgcaccactccgaccgcaagccctacctgctgagcccagtggagcaccaccccgcagaccacccatactacacccagcggaactccttccaggctgagtgcgtgggccccttcagcgacccgctggccagcagcaccttcccccgcaggcactacacctcgcagcaagagctgaaggacgagtgtgccctggtgccccgcaccctggccaccaaggcgaaccgcatccccgccaacctgctggaccagttcgagcggcagctgccactcagccgcgatggctatcacaccctgcagtacaagcgcacggccgtggagcaccgcagcgacagccccggccgcatccgccacctggtgcactcggtccagaagctcttcaccaagtcgcactccctggaggggccgtccaagggcagcgtcaacgggggcaaggccagccctgacgaggcgcaggcggcgcgctatggcaaacgcagcaagagcaaggagcggcgcgcggagcccaaggcccggcccagcacctccccgggctggtggagctcggacgacaacctggatggtgacatgtgcatctaccacgccccctcgggcgtgatgaccatgggcaggtgccccgaccgctcggcctcacagtacttcctggaggcctacaacaccatcagcgagcaggcggtgaaggcctcccggagcaacaacgacgtcaagtgctccacctgcgccaacctgccggtcagcctggacaccccgctgctgaagaagagcgcctggtcctccacgctcaccgtgagccgggcccgggaggtttaccagaaggcctcggtgaacatggaccaggccatggtgaagtccgagtcgtgtcagcaagaacgctcctgccagtacctgcaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccctttattttctgggcaaagccaaacccacctgtgtagaagtgatgcctttaggtcacccgccgtcctcagttctctcgagctagtctgttcagcaatataaaaccatagggtatttcagaaatccagtatcacagggtgatcctttgggacttaccgtcttccacgtgaaagaaactaggcctccgattccctttatttcccctaaatggttattcttttaaaaaagcagatggagcactttattcccaacctcagaaatcacaccatctcactggaatccatgagggacacagagagaggggaccaagcctggcctgggggtgggggacctggatgtgtagcaaggatgggagaagcgaaatctgcaggtgctgggggcacctgcacactcacagctgcacaaactgcctcactgttacttcatcaatcacagcttcaaatgtctcaatcagcagaagattgtaaattcgatctttcagggaaattaatctattctgaaaggcaataacatgaagcaaggcaaaggaggcactgatggtttagtatactacataagggatttttttgttctattattaagaaaatctagacctgaaatgttttctcaactcttattgtactgtgtatatttatattgttgtcgtggcggctgtttttaaagggaaagtgttggttctattaatttgttaagtgtccatccaggtgggcctacctgattccacatatataagtacatatctgcttataaagcgctgtaaatggcagcaaggctgtttttggagaagagtttgggttttcctaccatccctttgaatgctacacatccgtctattttaacccaagtagttcgtatttcagatatattttctcctttcatctcctctcactactgcagagtccagtaatacctagcataggattctgtcctgtgtcaaatggctaaaataaatttttgccccaatagacatgctgcctcattcaaaagagctgccgctgtcatcttgaggttccaggtagtgagagaagaaactcgacctgccagggtcaacagccatgaagaggtggggggagtcatgattcataaacactgaaagaagtcaaggcttttggcagagagtgttgatttagatttttagtcttgattgatgggcagtatgcatcggtgtctagctgaagttgtctttaaatgcccttactcgtcacagtttaaacacttaggatgtggcaatcttaagtatcaatggcattttatgtccagctaacatcctaaagcattagaaattaaaaacgaaagacttttaaaaacatacatcaaacatgcttgcaccagagaagctttttaaaataatacactctcatagccaggtgctaatttaattttacttatgaaattaagagaggtgatgggttctagcaacagatattttcacggacatattctaaaaccactagagaattcgctacctctcagagccatcgatgctttgagctacctttataaacagggcacaaatgtttactgctgtggtttacaagaaaagggctactcacttattttgaaaccaacgaaccaacttttaactagggtgaacaaagcactcaaagtgctttgtgaaattggagcatacagagattttgagcttcaagtatttgctagttttaaaaagaatacaccttttctttaccttgtagcagcaattaaaagtcacacaaagcttgcatcgagtagggccaactgccacttgggtagcctatggtcacattcaatactgagaatgacttggaactcacagattaatatgaaagaagcagcgttcatcccaagacccatgctcacaattacagctccgtgccctgaggtagagttgagatttggattaagaaatagatttctaatacgactcaagatcatcctacaatattttctttggaaactaatttagcccatgatattttaaagagagacaagagaaggcctatttatcttgtctaagtgaacggcatttgtatattcataagctatttttggtaagaattttaaatcttttagctcaaggcctacagggcatcatgatctttgccttccttgaaaatacaatttaaattgtacaaacactttataaaaagctaattattggtgttagaacatgaccccacacaatgctgcttgacccctgaaactgacattcatgagcataacctttgttacattgttctttttgatgtaatttgtagaaatgttttttagttcgtaatggaaaatgtatgtaccctgaaaaattacttattttgtttaactttggtataaaggtgttgggcattttcttggggagggggggattacaaaagaagtttgtctcccacatcaaaaaacgttcaaagaaattaagtatttattatattttttgcagatgtttccatacaattcacataacctttttgtaaagagagatgaagaaatggattaaagatttttaatatttgaaatggtaaatagaactaatttattgtaatatatttctgttatttatagatgtttccttaatgttttactgtgcattaccactttcatttaagccttatccttgtgaatttaccatttcttttttaaaacatgtctagatgcatattttaaataactggaatgtaaatcactagcatatctgaattcccaaatgtaatttttaaaaattattttggtttggaaaaaaaagattcatttgaaagccttcagatggaggggtgggaacatttttatggctttatgaattggaatttcataggcttatttacctagattgtgtgtgaacaaaaaaatattgtaaatagatgaatgtttcccataatgtaaaaagaagaaattaataaaataattaatgcactgct

SEQ ID NO: 1940 - DNA, 5258 bp, Homo sapiens
cacttagaatcggcaaatcatagagagaagctaaatgctctcagctgcactataccaaatcaaagctgagatgaataatgaacttaattttccataaagacattctgtttggcattccagctaataaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccctttattttctgggcaaagccaaacccacctgtgtagaagtgatgcctttaggtcacccgccgtcctcagttctctcgagctagtctgttcagcaatataaaaccatagggtatttcagaaatccagtatcacagggtgatcctttgggacttaccgtcttccacgtgaaagaaactaggcctccgattccctttatttcccctaaatggttattcttttaaaaaagcagatggagcactttattcccaacctcagaaatcacaccatctcactggaatccatgagggacacagagagaggggaccaagcctggcctgggggtgggggacctggatgtgtagcaaggatgggagaagcgaaatctgcaggtgctgggggcacctgcacactcacagctgcacaaactgcctcactgttacttcatcaatcacagcttcaaatgtctcaatcagcagaagattgtaaattcgatctttcagggaaattaatctattctgaaaggcaataacatgaagcaaggcaaaggaggcactgatggtttagtatactacataagggatttttttgttctattattaagaaaatctagacctgaaatgttttctcaactcttattgtactgtgtatatttatattgttgtcgtggcggctgtttttaaagggaaagtgttggttctattaatttgttaagtgtccatccaggtgggcctacctgattccacatatataagtacatatctgcttataaagcgctgtaaatggcagcaaggctgtttttggagaagagtttgggttttcctaccatccctttgaatgctacacatccgtctattttaacccaagtagttcgtatttcagatatattttctcctttcatctcctctcactactgcagagtccagtaatacctagcataggattctgtcctgtgtcaaatggctaaaataaatttttgccccaatagacatgctgcctcattcaaaagagctgccgctgtcatcttgaggttccaggtagtgagagaagaaactcgacctgccagggtcaacagccatgaagaggtggggggagtcatgattcataaacactgaaagaagtcaaggcttttggcagagagtgttgatttagatttttagtcttgattgatgggcagtatgcatcggtgtctagctgaagttgtctttaaatgcccttactcgtcacagtttaaacacttaggatgtggcaatcttaagtatcaatggcattttatgtccagctaacatcctaaagcattagaaattaaaaacgaaagacttttaaaaacatacatcaaacatgcttgcaccagagaagctttttaaaataatacactctcatagccaggtgctaatttaattttacttatgaaattaagagaggtgatgggttctagcaacagatattttcacggacatattctaaaaccactagagaattcgctacctctcagagccatcgatgctttgagctacctttataaacagggcacaaatgtttactgctgtggtttacaagaaaagggctactcacttattttgaaaccaacgaaccaacttttaactagggtgaacaaagcactcaaagtgctttgtgaaattggagcatacagagattttgagcttcaagtatttgctagttttaaaaagaatacaccttttctttaccttgtagcagcaattaaaagtcacacaaagcttgcatcgagtagggccaactgccacttgggtagcctatggtcacattcaatactgagaatgacttggaactcacagattaatatgaaagaagcagcgttcatcccaagacccatgctcacaattacagctccgtgccctgaggtagagttgagatttggattaagaaatagatttctaatacgactcaagatcatcctacaatattttctttggaaactaatttagcccatgatattttaaagagagacaagagaaggcctatttatcttgtctaagtgaacggcatttgtatattcataagctatttttggtaagaattttaaatcttttagctcaaggcctacagggcatcatgatctttgccttccttgaaaatacaatttaaattgtacaaacactttataaaaagctaattattggtgttagaacatgaccccacacaatgctgcttgacccctgaaactgacattcatgagcataacctttgttacattgttctttttgatgtaatttgtagaaatgttttttagttcgtaatggaaaatgtatgtaccctgaaaaattacttattttgtttaactttggtataaaggtgttgggcattttcttggggagggggggattacaaaagaagtttgtctcccacatcaaaaaacgttcaaagaaattaagtatttattatattttttgcagatgtttccatacaattcacataacctttttgtaaagagagatgaagaaatggattaaagatttttaatatttgaaatggtaaatagaactaatttattgtaatatatttctgttatttatagatgtttccttaatgttttactgtgcattaccactttcatttaagccttatccttgtgaatttaccatttcttttttaaaacatgtctagatgcatattttaaataactggaatgtaaatcactagcatatctgaattcccaaatgtaatttttaaaaattattttggtttggaaaaaaaagattcatttgaaagccttcagatggaggggtgggaacatttttatggctttatgaattggaatttcataggcttatttacctagattgtgtgtgaacaaaaaaatattgtaaatagatgaatgtttcccataatgtaaaaagaagaaattaataaaataattaatgcactgct

SEQ ID NO: 1941 - DNA, 3267 bp, Homo sapiens
cagagcagttgaacatcagatacccagagtgacatcaggttaaaaaaaagcctgcaatttggatcttttcctgactcggaagcaaggaaaatggacaattgataatcaaaggctaaatctcttctgggatccactgaatgccactagagggtctgctcgagagaattcctgattgaatgacaacggcgctaagaacaatccctgcccaagacgggtctggagcctgacttccgggtgtccatgaccctggcggctgcttccggtccgccatgaaagggctatcaggcagccgcagccatcaccacggggtcacctgcgactcggcctgtgactcgctgtcgcaccactccgaccgcaagccctacctgctgagcccagtggagcaccaccccgcagaccacccatactacacccagcggaactccttccaggctgagtgcgtgggccccttcagcgacccgctggccagcagcaccttcccccgcaggcactacacctcgcagcaagagctgaaggacgagtgtgccctggtgccccgcaccctggccaccaaggcgaaccgcatccccgccaacctgctggaccagttcgagcggcagctgccactcagccgcgatggctatcacaccctgcagtacaagcgcacggccgtggagcaccgcagcgacagccccggccgcatccgccacctggtgcactcggtccagaagctcttcaccaagtcgcactccctggaggggccgtccaagggcagcgtcaacgggggcaaggccagccctgacgaggcgcaggcggcgcgctatggcaaacgcagcaagagcaaggagcggcgcgcggagcccaaggcccggcccagcacctccccgggctggtggagctcggacgacaacctggatggtgacatgtgcatctaccacgccccctcgggcgtgatgaccatgggcaggtgccccgaccgctcggcctcacagtacttcctggaggcctacaacaccatcagcgagcaggcggtgaaggcctcccggagcaacaacgacgtcaagtgctccacctgcgccaacctgccggtcagcctggacaccccgctgctgaagaagagcgcctggtcctccacgctcaccgtgagccgggcccgggaggtttaccagaaggcctcggtgaacatggaccaggccatggtgaagtccgagtcgtgtcagcaagaacgctcctgccagtacctgcaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggtagaacaatgtagattttgtatggttcatttaaaaacctgcacaaacactggacagtctaaataggcttctgcattcagtcctgctgtttacaatgtgaaatggagctgatatcatattaatttcattgtaatgacaatgtttacatagtaatcatttgggatattatctgtaatatgtttcaggcatatttttaaagaaaaacctgtctttgtgaattggaaaatgggaatgtggctttttttgttaattaaactttaagttaaaccatttt

SEQ ID NO: 1942 - DNA, 2365 bp, Homo sapiens
gctgtttagaactattgtaccgctgccagtgactgtctgtattagggttgggagcaggaacatggatttgaagacattaaaactgtttaattctcagttgagatgtggttggctcttatacatttggaataaagcatttatggcacatctcagggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccctttattttctgggcaaagccaaacccacctgtgtagaagtgatgcctttag

SEQ ID NO: 1943 - DNA, 2402 bp, Homo sapiens
acttagaatcggcaaatcatagagagaagctaaatgctctcagctgcactataccaaatcaaagctgagatgaataatgaacttaattttccataaagacattctgtttggcattccagctaataaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacgggtgtcataaaactgagttctgcagttgaagtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccct

SEQ ID NO: 1944 - DNA, 3587 bp, Homo sapiens
atgaggggttaccatggcgaccgaggcagccatccccgcccagcccgctttgctgaccaacagcatatggacgtgggccctgctgccagggccccatacctgctgggctccagggaggccttctccaccgagccccgcttctgtgccccgagagctggcctgggacacatttctcctgaagggcccctgagcctgagtgaggggccgtcggtaggccctgagggagggccagcgggggccggggttggggggggtagcagcaccttccccaggatgtaccctggccagggccccttcgacacctgtgaagactgtgtgggccacccacagggcaagggtgccccccgcctgcctcctacactcctggatcagtttgaaaagcagttgccagttcaacaagatggcttccacacactaccataccagcgagggccagcaggggcagggcccgggccagcgccagggacgggcactgccccagagccccgcagtgagagccctagccgcatccggcacctggttcattctgtgcagaagctctttgccaagtcccactctctggaggcgccggggaagcgggactataatgggcccaaggctgagggaagaggtggctctggaggagacagctaccccggcccgggctctggaggcccccacacctcccatcaccaccatcaccaccaccatcaccaccaccaccagtcccggcacggcaagaggagcaagagcaaggaccgcaagggggatgggcggcaccaggccaagtccacaggctggtggagttccgatgacaacttggacagtgatagcggcttcctggcgggtgggaggccccctggggagcctggtggtcccttctgcctggagggtccagatgggtcctaccgggacttgagcttcaaggggcgctcgggcgggtcggaaggccgctgccttgcctgcactggcatgtccatgtcactggatggacagtcggtcaagcgaagtgcctggcataccatgatggtcagccagggccgggatggatacccgggggccgggccaggcaaggggctcctgggtccggagaccaaggccaaagccaggacttatcactatctgcaggtgccgcaagatgactgggggggttaccccaccggtggcaaggatggggagatcccctgccgcaggatgcggagcggcagctacatcaaagccatgggggatgaggagagcggagactcagacggcagccccaagacatctcccaaagcagtcgcccgacgcttcaccacccgtcgctcctccagcgtggaccaggccaggatcaactgctgtgtcccaccccggatccacccccggagctccatccctggctacagccgttccctcaccactggacagctcagcgatgagttgaaccagcagctggaggccgtgtgcgggtcggtgtttggggagctggagtcccaggccgtggacgccctggacctgcccggctgtttccgcatgcggagccacagctacctccgggccatccaggccggctgctctcaagacgacgactgcctgcccctcctcgctacccctgccgctgtctcagggaggcccggctcctccttcaacttcagaaaggccccgccccccatcccgccgggaagccaggccccgccccgcatctccatcaccgcccagagcagcaccgactccgcgcacgagagcttcacggcggccgagggccccgcccggcgctgcagctccgccgacgggctggacggccccgccatgggtgcgcgcacactggagttggcgccggtgccgccccgggccagccccaagccccccacactcatcatcaagaccatccctggcagggaggagctgcggagcctggcgcggcagcggaagtggcggccgtccattggggtgcaggtggagacgatctcagattcggacaccgagaacaggagccggagggagttccactctattggcgtgcaggtggaagaggacaagaggcgagcaaggttcaagcgctccaatagtgtgacggctggcgtgcaggcagacctggagctggagggcctggcaggcctggccacggtggccacagaagacaaggccctgcagtttggacgctccttccagaggcacgcctctgagccccagcctgggccccgggcccccacctactcagtcttccgcacggtccacacgcagggccagtgggcctaccgcgagggctacccactgccgtacgagccgccggccaccgatgggtcgcccggccctgcccccgcccccacccccggccctggggccggccgccgtgactcctggatagagcgcggttcacgtagcctccccgactcaggccgcgcatccccctgcccacgcgacggcgagtggttcatcaagatgctgcgggcagaggtggagaagctggagcactggtgccagcagatggagcgtgaggcggaggactatgagctacccgaggagatcctggagaagatccgcagtgctgtgggcagcacacaacttctcctgtcccagaaggttcagcagttcttccggctgtgtcagcaaagcatggatcccactgcgttccctgtgcccaccttccaggacctggcgggtttctgggacctcctacagctctccatcgaggatgtgaccctcaagttcctggagctacagcaactcaaggccaacagctggaaactcctggagcctaaggaggagaagaaggtccctccgccgataccaaagaagcccctgcggggccggggcgtgccggtgaaggagcgctccctggactccgtggaccggcagcggcaggaagcgcgcaagcggctcctggcggccaagcgcgccgcttccttccgccacagctcggccaccgagagcgccgacagcatcgagatctacatccccgaggcccagaccaggctgtgaccggtccggcccgcccagcccggcccgggcccgcggttctccacccgtactgtacacccagcgtcgaggtcactgtgaacgcgggccgccccgtgcgcccgccccaccggcaccggacgccccggcccccgggcccgtcacactctcgtgggttttttaccttcctgatcccacgcgaaggcgcccgggctgggcagggggccgtgcctctccgccctgcgcccctcacctggatcccctgcccacctggtccgacgctttgtccccacctcctccccatgggcaccatctctgccattctttcccccacgggccaggccgggccgggtccctcatctgggctctgcgtccccccctcccccaccccgcggggctgggcttcgtggggatcaagcttcgtggctttttatgaagaatcccgaaccctgcctaggagcccgccccaccctcccaggggctccatcctcagccctctgcccactgggcccagggaccacagtggctggaccaacccaggaccagggcgcctgggcctctcccctttcccagcggctggggaggggagatgggggcttcccctcaccacacctgtggctgttcccacatccccttgaatatcccaggaaaaataaaacggcagaactgca

SEQ ID NO: 1945 - DNA, 3856 bp, Homo sapiens
cgcagccggcgcggcccctcagctgggggctccgcagtgccgggccccggtccctgcccgcctgcccaacgccgcagcgcccccggcccgggccgccggcaccatgtaacccggccggagcccgagccgggccaggattcagtggtcctgagccttctgaagttaggcttctgcctggtggtggggatcctgacatcaaggatgggacaccctggatggaggttcctggggcctggcccccaagactatgaagagcctttgctgaggccatgaggggttaccatggcgaccgaggcagccatccccgcccagcccgctttgctgaccaacagcatatggacgtgggccctgctgccagggccccatacctgctgggctccagggaggccttctccaccgagccccgcttctgtgccccgagagctggcctgggacacatttctcctgaagggcccctgagcctgagtgaggggccgtcggtaggccctgagggagggccagcgggggccggggttggggggggtagcagcaccttccccaggatgtaccctggccagggccccttcgacacctgtgaagactgtgtgggccacccacagggcaagggtgccccccgcctgcctcctacactcctggatcagtttgaaaagcagttgccagttcaacaagatggcttccacacactaccataccagcgagggccagcaggggcagggcccgggccagcgccagggacgggcactgccccagagccccgcagtgagagccctagccgcatccggcacctggttcattctgtgcagaagctctttgccaagtcccactctctggaggcgccggggaagcgggactataatgggcccaaggctgagggaagaggtggctctggaggagacagctaccccggcccgggctctggaggcccccacacctcccatcaccaccatcaccaccaccatcaccaccaccaccagtcccggcacggcaagaggagcaagagcaaggaccgcaagggggatgggcggcaccaggccaagtccacaggctggtggagttccgatgacaacttggacagtgatagcggcttcctggcgggtgggaggccccctggggagcctggtggtcccttctgcctggagggtccagatgggtcctaccgggacttgagcttcaaggggcgctcgggcgggtcggaaggccgctgccttgcctgcactggcatgtccatgtcactggatggacagtcggtcaagcgaagtgcctggcataccatgatggtcagccagggccgggatggatacccgggggccgggccaggcaaggggctcctgggtccggagaccaaggccaaagccaggacttatcactatctgcaggtgccgcaagatgactgggggggttaccccaccggtggcaaggatggggagatcccctgccgcaggatgcggagcggcagctacatcaaagccatgggggatgaggagagcggagactcagacggcagccccaagacatctcccaaagcagtcgcccgacgcttcaccacccgtcgctcctccagcgtggaccaggccaggatcaactgctgtgtcccaccccggatccacccccggagctccatccctggctacagccgttccctcaccactggacagctcagcgatgagttgaaccagcagctggaggccgtgtgcgggtcggtgtttggggagctggagtcccaggccgtggacgccctggacctgcccggctgtttccgcatgcggagccacagctacctccgggccatccaggccggctgctctcaagacgacgactgcctgcccctcctcgctacccctgccgctgtctcagggaggcccggctcctccttcaacttcagaaaggccccgccccccatcccgccgggaagccaggccccgccccgcatctccatcaccgcccagagcagcaccgactccgcgcacgagagcttcacggcggccgagggccccgcccggcgctgcagctccgccgacgggctggacggccccgccatgggtgcgcgcacactggagttggcgccggtgccgccccgggccagccccaagccccccacactcatcatcaagaccatccctggcagggaggagctgcggagcctggcgcggcagcggaagtggcggccgtccattggggtgcaggtggagacgatctcagattcggacaccgagaacaggagccggagggagttccactctattggcgtgcaggtggaagaggacaagaggcgagcaaggttcaagcgctccaatagtgtgacggctggcgtgcaggcagacctggagctggagggcctggcaggcctggccacggtggccacagaagacaaggccctgcagtttggacgctccttccagaggcacgcctctgagccccagcctgggccccgggcccccacctactcagtcttccgcacggtccacacgcagggccagtgggcctaccgcgagggctacccactgccgtacgagccgccggccaccgatgggtcgcccggccctgcccccgcccccacccccggccctggggccggccgccgtgactcctggatagagcgcggttcacgtagcctccccgactcaggccgcgcatccccctgcccacgcgacggcgagtggttcatcaagatgctgcgggcagaggtggagaagctggagcactggtgccagcagatggagcgtgaggcggaggactatgagctacccgaggagatcctggagaagatccgcagtgctgtgggcagcacacaacttctcctgtcccagaaggttcagcagttcttccggctgtgtcagcaaagcatggatcccactgcgttccctgtgcccaccttccaggacctggcgggtttctgggacctcctacagctctccatcgaggatgtgaccctcaagttcctggagctacagcaactcaaggccaacagctggaaactcctggagcctaaggaggagaagaaggtccctccgccgataccaaagaagcccctgcggggccggggcgtgccggtgaaggagcgctccctggactccgtggaccggcagcggcaggaagcgcgcaagcggctcctggcggccaagcgcgccgcttccttccgccacagctcggccaccgagagcgccgacagcatcgagatctacatccccgaggcccagaccaggctgtgaccggtccggcccgcccagcccggcccgggcccgcggttctccacccgtactgtacacccagcgtcgaggtcactgtgaacgcgggccgccccgtgcgcccgccccaccggcaccggacgccccggcccccgggcccgtcacactctcgtgggttttttaccttcctgatcccacgcgaaggcgcccgggctgggcagggggccgtgcctctccgccctgcgcccctcacctggatcccctgcccacctggtccgacgctttgtccccacctcctccccatgggcaccatctctgccattctttcccccacgggccaggccgggccgggtccctcatctgggctctgcgtccccccctcccccaccccgcggggctgggcttcgtggggatcaagcttcgtggctttttatgaagaatcccgaaccctgcctaggagcccgccccaccctcccaggggctccatcctcagccctctgcccactgggcccagggaccacagtggctggaccaacccaggaccagggcgcctgggcctctcccctttcccagcggctggggaggggagatgggggcttcccctcaccacacctgtggctgttcccacatccccttgaatatcccaggaaaaataaaacggcagaactgca

SEQ ID NO: 1946 - DNA, 1746 bp, Homo sapiens
atgaggggttaccatggcgaccgaggcagccatccccgcccagcccgctttgctgaccaacagcatatggacgtgggccctgctgccagggccccatacctgctgggctccagggaggccttctccaccgagccccgcttctgtgccccgagagctggcctgggacacatttctcctgaagggcccctgagcctgagtgaggggccgtcggtaggccctgagggagggccagcgggggccggggttggggggggtagcagcaccttccccaggatgtaccctggccagggccccttcgacacctgtgaagactgtgtgggccacccacagggcaagggtgccccccgcctgcctcctacactcctggatcagtttgaaaagcagttgccagttcaacaagatggcttccacacactaccataccagcgagggccagcaggggcagggcccgggccagcgccagggacgggcactgccccagagccccgcagtgagagccctagccgcatccggcacctggttcattctgtgcagaagctctttgccaagtcccactctctggaggcgccggggaagcgggactataatgggcccaaggctgagggaagaggtggctctggaggagacagctaccccggcccgggctctggaggcccccacacctcccatcaccaccatcaccaccaccatcaccaccaccaccagtcccggcacggcaagaggagcaagagcaaggaccgcaagggggatgggcggcaccaggccaagtccacaggctggtggagttccgatgacaacttggacagtgatagcggcttcctggcgggtgggaggccccctggggagcctggtggtcccttctgcctggagggtccagatgggtcctaccgggacttgagcttcaaggggcgctcgggcgggtcggaaggccgctgccttgcctgcactggcatgtccatgtcactggatggacagtcggtcaagcgaagtgcctggcataccatgatggtcagccagggccgggatggatacccgggggccgggccaggcaaggggctcctgggtccggagaccaaggccaaagccaggacttatcactatctgcaggtgccgcaagatgactgggggggttaccccaccggtggcaaggatggggagatcccctgccgcaggatgcggagcggcagctacatcaaagccatgggggatgaggagagcggagactcagacggcagccccaagacatctcccaaagcagtcgcccgacgcttcaccacccgtcgctcctccagcgtggaccaggccaggatcaactgctgtgtcccaccccggatccacccccggagctccatccctggctacagccgttccctcaccactggacagctcagcgatgagttgaaccagcagatggagcgtgaggcggaggactatgagctacccgaggagatcctggagaagatccgcagtgctgtgggcagcacacaacttctcctgtcccagaaggttcagcagttcttccggctgtgtcagcaaagcatggatcccactgcgttccctgtgcccaccttccaggacctggcgggtttctgggacctcctacagctctccatcgaggatgtgaccctcaagttcctggagctacagcaactcaaggccaacagctggaaactcctggagcctaaggaggagaagaaggtccctccgccgataccaacccggcccccgggcccgtcacactctcgt

SEQ ID NO: 1947 - DNA, 3022 bp, Homo sapiens
ctttaagtcacgtgacatgaggagaggtgggcgggtacctggaggaagctcgcggcgtcggtggcggtggcgcgcggcggccgctgagaccggggctttgagtcgcaccccgcggcccgccccccgccgccaccctcgcagatccgtgctttttcccctttgcttctctcccgtactgggtcagtcctgtccgcgctcgcgcgtcggtttgcgggtgtgcgcaggcgcggcaggggccattagccctttgggtgggcggtggagcccgggagcgcgcgggcgagaccatggcgggtagcagcactgggggcggtggggttggggagacgaaggtgatttaccacctggatgaggaagagactccctacctggtgaagatccctgtccccgccgagcgcatcaccctcggcgatttcaagagcgtcctgcagcggcccgcgggcgccaagtactttttcaagtctatggatcaggatttcggggtggtgaaggaagaaatttcagatgacaacgcccgcctcccctgcttcaacggaagggtggtatcctggctggtgtcctcagataatccccaacccgagatggcccctccagtccatgagcctcgggcagaactggcgcctccagccccacctttacctcctttgccacccgagaggaccagcggcattggggactcaaggcctccatccttccaccctaatgtgtccagcagccatgagaatctggagcctgagacagaaaccgagtcagtagtgtcactgaggcgggagcggcctcgcaggagagacagcagtgagcatggcgctgggggccacaggactggtggcccctcaaggctggagcgccacctggccggatacgagagctcctctaccctcatgaccagcgagctggagagtaccagcctgggggactcggacgaggaggacaccatgagcaggttcagcagctccacggagcagagcagtgcctcccgcctccttaagcgccaccggcggcgaaggaagcagaggccaccccgcctggagaggacgtcatccttcagcagcgtcacagattccacaatgtctctcaatatcatcacagtcacgctaaacatggagaagtacaacttcctgggtatctccattgttggccagagcaatgagcggggagacggaggcatctacattggctccatcatgaagggtggggctgtggcggccgacgggcgcattgagccaggggacatgcttttgcaggtgaatgacatgaactttgagaacatgagcaacgatgacgctgtgcgggtgctgagggacattgtgcacaagcctggccccattgtgctgactgtggccaagtgctgggatccctctcctcaggcctatttcactctcccccgaaatgagcccatccagccaattgaccctgctgcctgggtgtcccattccgcggctctgactggcaccttcccagcctatccaggttcctcctccatgagcaccattacatctggatcgtctttgcctgatggctgtgaaggccggggtctctccgtccatacggacatggcatcggtgaccaaggccatggcagctccagagtctggactggaagtccgggaccgcatgtggctcaagatcaccatccctaatgcctttctgggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggagacctcagtggtggctgtgagagctacctagtcaacctgtctctcaatgacaacgatggctccagtggggcttcagaccaggataccctggctcctctgcctggggccaccccctggcccctgctgcccactttctcctaccaataccctgccccacacccctacagcccgcagcctccaccctaccatgagctttcatcttacacctatggtgggggcagtgccagcagccagcatagtgagggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctccatccagaggctcaactgggggtgcccctaatctccgagcccacccagggctccatccctatggaccgccccctggcatggccctcccctacaaccccatgatggtggtcatgatgcccccacctccacctccagtccctccagcagtgcagcctccgggggcccctccagtcagagacctgggctctgtgcccccagaactgacagccagccgccaaagcttccacatggccatgggcaatcccagcgagttctttgtggatgttatgtagcccactgtggggccaggctgggccgggcgctcctggtgtgtgactgggtgtcctggccgtcatgtgcttgctcttacagtgcctgggctcagcctaccagctgctgccatacaggagattgtggccactgtgactctcaccagcagtgcctggttcctcccccttccctcaggggtagacaagggacctttgattatttttagctttgtttttttataagcctttttgggggttaaaatagagtttcttacatttttgggacttttttaataggcatttcctcttttatatgaagaattcccatccattgggccccttctaaccccagaatgtgacctcctcctccagttacccacagccctgccctttgcagggttgggggtggtcagcggtaccccggggttaggcatcctagacagcagcctgaggaagctgggagatttgggccatgtagctgcctttgttactctatttattttagtcacttgtataaaacaccaaataaagcaatagaggcaaactcc

SEQ ID NO: 1948 - DNA, 4762 bp, Homo sapiens
attcagtctgtcctgccgctctgtggagctgcgcctgccaactcattgctttctgctgtgctgtgatcctgcagtcagttgccgctgttgctactgcaatcatttgcaccaaactgagccagagaagttccctcttttaacataaagagtcaagaaattggagcatggctatgagcaatggaaacaatgattttgtggttctgagcaacagcagcatcgcaaccagtgctgctaacccgagtcccctcaccccctgtgatggagaccatgcagcccagcagctcacacccaaagaagcaacaagaacaaaagtgagtccaaatggatgcctgcaacttaatggcacggtcaaatcatcctttctgcctttagacaaccaaagaatgcctcagatgttaccccaatgctgccatccttgcccataccatcaccctttgactagccatagcagtcaccaagagtgccatcccgaggctggccctgcagcaccctctgctttggcctcgtgttgcatgcagccacactccgagtattctgcatctctttgtccaaatcattcacctgtgtatcagactacgtgctgtcttcagccctctccatccttctgcctgcatcatccgtggcctgaccattttcagcatcagcctgtgcaacagcacatagccaacataagaccatccagacctttcaagttgccaaaaagttatgcagccctgatagccgactggccggtggtggtcttgggcatgtgcaccatgttcatcgtagtctgtgccttggttggagtattagtgccagagctccctgacttctctgatccattgctgggttttgaaccaagaggaacagcaataggccagagattggtcacatggaataatatggtgaaaaatacaggatacaaagcaacattagcaaattatccctttaaatatgcagatgaacaagccaaaagccatcgggatgatagatggtcagatgatcattatgaaagagagaaaagagaagttgactggaacttccacaaggacagctttttctgcgacgttccaagtgaccgatattccagagtggtatttacttcatctggaggggagacattatggaatttacctgcaattaaatcaatgtgcaatgtagataattccaggatcagatctcatccccagtttggtgatctctgccagaggaccactgctgcctcctgctgccccagctggacactgggaaactacatcgccattctgaacaatagatcgtcctgtcagaaaatagttgagcgagacgtttctcataccttgaagctgcttcggacttgtgccaaacactaccaaaatggcactctggggccagactgctgggacatggcagccagaagaaaggaccagctcaagtgcaccaatgtgccacgcaaatgtaccaagtacaatgctgtgtaccagatcctccattacttggtggacaaagactttatgaccccaaagacggctgactatgccacgccagctttaaaatacagcatgctcttctctcccacagagaaaggggagagcatgatgaacatttacttggacaactttgaaaactggaactcttctgacggcgtgactaccatcaccgggattgagtttggtatcaaacacagtttgtttcaggattatcttctaatggatactgtgtatcctgccatagccattgtgattgtccttttagttatgtgtgtctacaccaagtccatgtttatcactctgatgacaatgtttgcaataatcagttctttgattgtttcctattttctctatcgtgtagtatttcacttcgaattttttccttttatgaacctcactgccctcattattttggttggaattggagcagatgatgcttttgtcctgtgtgatgtttggaactacacaaaatttgataagcctcatgccgaaacctcagaaacagtaagcatcaccttgcagcacgctgccctctccatgttcgtcaccagttttaccactgctgctgccttttatgctaactatgttagcaacattacagcaatccgatgctttggggtttatgcggggacagctatattggtgaattacgttttgatggtcacatggcttccagcagttgttgtgctgcatgagcggtatcttcttaatatattcacttgcttcaaaaagccccagcagcaaatatatgataacaaaagctgctggacagtggcttgccagaagtgccacaaagtactctttgccatttcagaagcatctcgaatttttttcgaaaaagtattgccatgcattgtcattaagtttcgctacctttggctgttttggttccttgccttaactgtaggtggggcctacattgtatgtataaatccaaagatgaaactgccctcactggagttatccgagttccaggtgttccggtcgtcccatccttttgagcgttatgatgctgaatacaaaaagcttttcatgtttgaacgtgttcaccatggcgaggagctccacatgcccatcacagtaatctggggcgtgtccccagaagacaatggcaacccactaaatcccaagagtaaagggaagttgacattagatagcagttttaacatcgccagcccagcttcccaggcctggattttgcacttctgtcaaaaactgagaaaccaaacattcttttaccagactgatgaacaggacttcaccagctgcttcattgagacattcaaacagtggatggaaaaccaggactgtgatgagcctgccctgtacccatgctgcagccactggagcttcccctacaagcaagagatttttgaactgtgcatcaagagagctatcatggagctggaaaggagtacagggtaccatttggatagcaaaaccccagggccgaggtttgatatcaatgatactatcagggcagtggtgttagagttccagagtacctacctcttcacactggcttatgaaaagatgcatcagttttataaagaggtggactcgtggatatccagtgagctgagttcggcccctgaaggcctcagcaatggttggtttgtcagcaatctggagttctatgacctccaggatagcctctccgatggcaccctcattgccatggggctgtcagttgctgttgcatttagcgtgatgctgctgacaacttggaacatcatcataagcctttatgccatcatttcaattgctggaacgatatttgtcactgttggttctcttgtcctgctgggctgggagctcaatgtgttggaatctgtcaccatttcggttgccgtcggcttgtctgtagactttgccgtccattatggggttgcctaccgcttggctccagatcccgaccgagaaggcaaagtgatcttctctctgagtcgcgtgggctctgcgatggccatggctgccctgaccaccttcgtggcaggggccatgatgatgccctccacagttctagcttacacccagctgggcaccttcatgatgctcatcatgtgtatcagttgggctttcgccaccttctttttccagtgcatgtgccggtgccttggaccacagggtacctgtggtcagattcctttacctaaaaaactacagtgcagtgccttttcccatgccttgtctacaagtcccagtgacaagggacaaagcaaaacacataccataaatgcttatcatttagatcccaggggcccaaaatctgaactggagcatgagttttatgaattagaacctctggcttcccacagctgcactgcccctgagaagaccacttatgaagagacccacatctgctctgaatttttcaacagccaagcaaagaatttagggatgcctgtgcatgcagcttacaacagtgaactcagcaaaagcactgaaagtgacgctggctctgccttgttacagccccctcttgaacagcataccgtgtgtcacttcttctctctgaatcagagatgtagctgcccagatgcctacaaacacttgaactatggcccacactcttgccagcagatgggggactgcttgtgccaccagtgctctcctaccactagcagctttgtccagatccaaaacggcgtggcacctctgaaggccacacaccaagctgtcgagggctttgtgcaccccatcacgcacatccaccactgtccctgcctgcagggcagagtaaagccagccggaatgcagaattctctgcctaggaattttttcctccacccagtgcagcacattcaggcccaagaaaaaattggcaagaccaatgtacacagtcttcagaggagcatagaagagcatcttccaaagatggcagagccatcgtcatttgtctgcagaagcactggatcgttactcaaaacgtgttgcgaccccgagaataaacaaagggaactctgtaaaaatagagacgtgagcaatctggagagcagtggagggactgaaaacaaggcaggagggaaagtggagctgagcttgtcacagacggatgcaagtgtgaactcagaacatttcaatcagaatgaaccaaaagtcctatttaatcatttaatgggggaggctggttgtaggtcttgcccaaataattcacaaagttgtggcagaattgtgagagtgaagtgcaattctgtggactgtcaaatgccaaacatggaagccaatgtgcctgctgtattaacacactcggaactttctggtgaaagtttgttaataaaaacactataataaatgcagcattcaattcagaa

SEQ ID NO: 1949 - DNA, 1070 bp, Homo sapiens
gctttggtatcaggatgatgctggcctcataaaatgagttaaggaggattccctctttttctattgattggaatagtttcagaaggaatggtaccagctcctccttgtgcctctggtagaattcggctgtgaatccatctggtcctggactttttttggttgtctgtcctgccgctctgtggagctgcgcctgccaactcattgctttctgctgtgctgtgatcctgcagtcagttgccgctgttgctactgcaatcatttgcaccaaactgagccagagaagttccctcttttaacataaagagtcaagaaattggagcatggctatgagcaatggaaacaatgattttgtggttctgagcaacagcagcatcgcaaccagtgctgctaacccgagtcccctcaccccctgtgatggagaccatgcagcccagcagctcacacccaaagaagcaacaagaacaaaagtgagtccaaatggatgcctgcaacttaatggcacggtcaaatcatcctttctgcctttagacaaccaaagaatgcctcagatgttaccccaatgctgccatccttgcccataccatcaccctttgactagccatagcagtcaccaagagtgccatcccgaggctggccctgcagcaccctctgctttggcctcgtgttgcatgcagccacactccgagtattctgcatctctttgtccaaatcattcacctgtgtatcagactacgtgctgtcttcagccctctccatccttctgcctgcatcatccgtggcctgaccattttcagcatcagcctgtgcaacagcacatagccaacataagattcaccagaaaaactaagtgtgcttcatggcttcttcagatgtgaacgtgttcactgaaagcccagtctgtgtaaagctgctaagccctcaccagctcactggagtggccctgcactccgtccctctatgcatacttggatagccctggccagctgagcgctgcaggtcaggaggctgctgtctcctacagccacacacttctgctcccagcatttgacaagtgtgcttaccaaacccac

SEQ ID NO: 1950 - DNA, 5031 bp, Homo sapiens
cgccgccgctgccgccgccaccgccgccgccgccgccgccgccgcggcttcagcaccagcgcccggacagcggtgccgcccacgggcatggacggtgacagcagcagcagcagcggcggcagcggtccggctcccggcccgggtccggaaggggagcaacggcccgagggggagcccttggccccagacggcggctccccggacagcacccagaccaaggctgtgccccctgaggcaagcccagagagaagctgctccctccacagctgccccctggaggacccttccagctcttcaggacccccaccaacaacttccaccctccagcctgtgggtccatccagccccttggcccctgcccacttcacctatccccgggcactgcaggaataccaggggggcagttccctgccaggacttggggatcgggcagctctctgctcccacggctccagcctcagcccttctccagccccctcacagcgcgatgggacctggaagccacccgctgtgcagcaccatgtggtcagcgtcaggcaggaacgagccttccagatgccaaagagctattcccagctgattgctgagtggccagtggccgtgctgatgctgtgtctggctgtcatcttcctctgcaccctggctggactgttgggggcccggctgcccgacttctccaagcctttgctgggctttgagccacgggacacagacattgggagcaagttagtggtctggagagcactacaagccctcacaggccccaggaagctgcttttcctttccccagaccttgagctgaacagctcgagctcccacaacactctgaggcctgcacccagaggcagtgcccaggagagcgctgtccggcctcggagaatggtggagcccctggaggacagaaggcaagagaacttcttctgtggcccccctgagaagagctatgcaaagctggtgttcatgtccacctcctcgggcagcctatggaacctgcatgccatccattccatgtgtcgcatggaacaggaccagatccgctcccataccagcttcggggctctgtgccagcggacagcagccaaccagtgctgccccagctggtccctgggcaactatctggctgtgctctccaaccgctcctcctgcctggacactacccaagctgacgcagcccgcacactggccctgcttcggacctgtgccctctactaccacagtggcgccttggtgccctcttgtctgggacctgggcagaacaagtccccacgctgtgcccaggttcccaccaagtgctcccagagtagtgccatctaccaactcctgcactttctgcttgacagggactttctgagtccccagaccactgactaccaggtgccttccctcaagtacagcctgctcttcctgcccaccccaaagggtgcttccctcatggacatctacctggaccggctggccaccccctgggggcttgctgacaactacacctctgtcactggcatggacctgggcctcaagcaggagctgctgaggcacttcctggtccaggacacggtgtaccccttgctggctctggttgccatcttcttcggcatggccctgtacctgcgctcactcttcctcacgctcatggtgctgctgggggtgctgggctcactgctggtggccttcttcctttaccaggtggccttccgcatggcctacttccccttcgtcaatctggcagccctcctcctgctgagcagcgtctgcgccaaccacacgctcatcttcttcgacctgtggcgccttagcaagagccagctgccgtcgggggggctggcgcagcgcgtgggccgcaccatgcaccacttcggctacctgctgctggtctccggcctcaccacgagcgcggccttctatgccagctacctgagccgcctgccggccgttcgctgcctcgccctcttcatgggcacggctgtgctggtgcacctggcgctcacgctggtctggctgcccgcctccgccgtgctccacgagcgctacctggcgcgcggctgtgcgcgccgggcgcggggccggtgggagggcagcgcgccccggcggctactgctggcgctgcaccggcggctccgcggcctgcggagggcggcggctggcacctcgcgtctgctcttccagcgcctgctgccctgcggcgtcatcaagttccgctacatctggatctgctggttcgcagcactggcggcagggggcgcctacatcgccggagtcagcccccgcctgcggctgcccacgctgccgccgcccggcggccaggtcttccggcccagccaccccttcgagcgcttcgacgcggagtatcgccagctgttcctgttcgagcagctgccgcagggcgagggcggccacatgcccgtggttttggtgtggggcgtcctgcctgtggacactggcgaccctctggaccctcgtagcaacagcagcctggtgagggaccctgccttctcggccagcggccctgaggcccagcgctggctgctggcactctgtcaccgggcccggaatcagagcttcttcgacaccctgcaggaaggctggcccacgctgtgtttcgtggagaccctccagcgctggatggagagccccagctgcgcccgcctggggcctgacctctgctgcggccactcggacttcccctgggccccccagtttttcctgcactgcctgaaaatgatggctctggagcaaggccccgatggcacccaggacctgggactccgctttgatgcccatggcagcctggccgccctggtcctacaattccagaccaacttccggaacagtccggactacaaccagacccagctcttctacaatgaggtcagccactggctggcagcggagctgggcatggcacctccaggcctccgccgtggttggttcactagccgtctagagctgtatagcctgcagcacagcctgagcactgagcctgctgtggtgctgggcctggctttggcgctggcctttgccacactgctcctgggcacctggaatgttcccctcagcctattctccgtggcagctgtggcaggcaccgtgctgctcactgtaggactcctggttctcctcgagtggcagctcaacactgccgaggccctgtttctctctgcctcagtgggcctctcagtagacttcactgtcaactactgcatctcctatcacctgtgcccacaccctgaccgcctgagccgtgtggccttctctctgcgccagaccagctgcgccacagccgtgggggctgcagccctgtttgcggcaggcgtgctcatgctgcctgccacagtgctgctctatcgcaagctgggcatcatcctcatgatggtcaaatgcgtcagttgtggctttgccagcttcttcttccaatctctctgctgtttcttcgggccagagaagaactgtgggcagatcctctggccctgtgcccacctgccatgggatgctggtactggggaccctggtggggagaaggcaggccgcccacgaccagggtcagtgggagggatgcccgggtcctgctcagagcaatatgagctacagcccctggcacggcgtcggagccccagctttgacaccagcacagccaccagcaagctgtcccaccggccctcagtactctctgaggatctgcagctccatgatggtccgtgctgttcccggcccccaccagcccctgcctccccaagggagctgctgctggaccaccaggcagtcttcagccagtgccctgccctgcagacctcctccccctataagcaggctggccccagccccaaaacccgggccaggcaggactcccaaggggaggaggctgagcccctgccagcctcaccagaagccccagcccactctcctaaggccaaggctgcagatcctcctgatggcttctgttcctcagccagcaccctggaggggctcagcgtctctgatgagacctgcctaagcacctctgagcccagtgcccgtgtaccagattccgtgggtgtgtccccagatgacctggatgacactgggcagccagtccttgagcgaggccagctcaatgggaagcgggacaccctgtggctggcgctgagggagacagtgtatgacccatcattgcccgcttcccatcacagcagcttgtcctggaagggccgaggggggccaggggatggcagccctgtggtgctgcccaatagccagccagacctgccagatgtttggctgcgcaggcccagcactcacacgtcaggctatagcagctgagggggacccggggaggctggacagggcgcggaaccctgtcatggatgacaaggcaagggcagcaataggctggagcccgaaggtatttctccagatccacagggagaggtctcaccctccagctgtggatgttaaaccctgccagatgtcccagccttgatctgtctgctcctactcctcacatctggaggattccagcaggaggggttttggaggggacctgcttgcgacctgctgagggcttgtctgctcccacagcaccatctaagacccctcctctagaagtggggaaggccagatgtgtagcttcgggtatcagaggaggctgacctggcccccatcccaagttacaagaacttcagtgagactaagggacccccatcctagggatcttgtcagggttccttactgaccagaggagcccgcagcaatctccacagcctcctgggtctcacccctttcatgggctcttcatcaggacacttccctctcttttgggagcttctctgggcagaattgggctgggacctctctccccaactgccctgctctcctcatactcaccggtttgaccagaaattctccaaatccagccatagatggctgctgggtgtgcagcaggagaaggaggatggtcagccttggagcatctctcaattacgggacagtccctctttggaagcaggctcctgtgctttcctgtgttaataaacagtaataatcctttccatctctgca

SEQ ID NO: 1951 - DNA, 5425 bp, Homo sapiens
atccggaaggtggcacggagtgggatcgccgctggggactcgaggcgcagcctgcgccgccgggagcctccctcccagtgggagatgggttgagatgcccccgccaggggggatgcccggcaccgtgcgtccgcggaggccaagatgcagcggccaggggccggcagcctgcgaggggaggcagcttccgccggggccgggctgctgcacagtctgagcggccgggactgcgcgcttcagagcctggagcatcccagtcgctggggccgagacgccgccgccgccgccgttcccgctttctcccgcgagccgggccagtagctttgctaggctggccttcccgtggaggcgttttccagccccagcgcggggagacatgcctgaatttgggagcgatgtgactctcagcctcccacttcacccggggacgcaggcttgctgaagcccgagacaggagggggaccatgggagggacgcaagtcaaatgcctgacttcacccagtccaatccacagtgcaaagagcgagtccattataacccagtcagaagagaaggcagattttgtgattattcccgctgaaggaatagagaacagaacagaagggacagattctccattatctcgagactggcggccagggcctggaacctatctggagacctcatgggaagaacagctgttggaacaacaagaatatttagaaaaagaaatggaggaagcaaagaaaatgatatcaggactacaggccttactgctcaatggatccttacctgaagatgaacaggagaggcccttggccctctgtgaaccaggtgtcaatcccgaggaacaactgattataatccaaagtcgtctggatcagagtatggaggagaatcaggacttaaagaaggaactgctgaaatgtaaacaagaagccagaaacttacaggggataaaggatgccttgcagcagagattgactcagcaggacacatctgttcttcagctcaaacaagagctactgagggcaaatatggacaaagatgagctgcacaaccagaatgtggatctgcagaggaagctagatgagaggaaccggctcttgggagaatataaaaaagagctggggcagaaggatcgccttcttcagcagcaccaggccaagttagaagaagcactccggaaactctctgatgtcagttaccaccaggtggatctagagcgagagctagaacacaaagatgtcctcttggctcactgtatgaaaagagaggcagatgaggcgaccaactacaacagtcacaactctcaaagcaatggttttctccttccaacggcaggaaaaggagctacttcagtcagcaacagagggaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaaagttgcctcactcacagagctctccaactgtcagcagcacctgtactaaagtgctctatttcactgaccggtcacttacgcccttcatggtcaatataccaaagaggttggaggaggtgacgttaaaggattttaaagcagctattgatcgggaaggaaatcaccggtatcacttcaaagcactggatcctgagtttggcactgtcaaagaggagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaattctgtccaaatgtagaccatgggttcatctggagttccttgtccgtgggaacacagtgttctattctactctgaggacaacaaaccgaaggccttaaacgatggggatggatgatcccgcctctgtaggggcatggctgctattatctggaaattaggaattggatgcatcattcctgtgtgttacagtattattttaattggcctcaatggttgcagcaatcagagtcccagcgtttgtactcacagacaaggcaaaggtaccagcttttctgtttctttgaacctactgcaaaccaagaataactcatgaggtggtaccaaagatgaaagcccagacttcagtaatcttttgaaccagacgtggatggtgctgaattgttgcttggatggaaaaagggctgcccatgttgtgctacactatgctaaaactgtaatttagtaagaccttgggctgcctcttctgtcttaactggttctgcagcttgtccttttgcccacatagggcctatttcatgtactgttagttttctctggggactctttaactttagagccatttctttttcttcaaactgatgaacttttgtttgaaaggcataaggagtgaaaagctccttgaaaatccaggcgggtatggaaaggtgctgctacccatatctttttgactttctttgtttcatgactttaactcatggcatctcctttgtagtaaaaggagacagaccattaatttcagcatttctttgtgatttataagtactgagcatgaagtacttgtctgcccctcatttcaaggccagagttattttctatttatgtattagtctaggctgatcttttagggcacaatagaaaccatggggcgtggagcatgagttgtgaatggcagggatcattctgggtaaaaaaaacctagaatcatttctgatgtgcaacattgtcaagtgaagaagctaacagttcaactaccgagattatttgataacctgggttttctcattcatccatcaagcaccatcaaccagtcagccattattatttatatatgtattaccaaaagcagtctatctgcctgtgacctccaatgtacactgccaaacacaagagtaggacacatctgttctgggttcttgacctatctgtctccaattcatctccccttttcagccatttcaacaaactactctttggagctctgagatgacatcttgttgttttatatagatgtatcttttaaaaatagttcacgtttggagaattcttttgtactcatttgctttttgtctgagaaccatgtctatttttataactggagtgtgagttctgtatcttctcacattctgtatactgtatccattttctagagaacccagtagcttttatacagtctcttcttaccaccccttgtggtttcagaacaagctttattttattacgagtatattaatgacaactaattcctgttccaattctacctgttttagttgtgaaggtagttttgtgtaatccagttgattgctcctctggcagagagaaggagctcaaaagatacttgatgtctttcatgtaagtttacctggtcttttcctattgaagaatttttcatcagaaacgactgggaaagtttgggaaagtcagcaaaagaaagaatgcatttcgaaagcaaacagaagaaaaaagtatattctcacagtttttccccaggaagtctggagaaaaagtcctcatgtcaccaatttctctgttgcatgaattttagtgttttgctataagacagcatgagggctatcaggccaaaattcattattgtatttccaatacagtttgtcttgaatgtctgtctcttaaaccagtttttacttgtcagttttctctcagcaaacagtcttactattatgtggaatttaacttttcagagaaaatttccaaagtcctctaccttatttggcttttatctgtgtcttttggaaaaggagctgcatggcctcagtgcctccataaaaagcttaagttgagttcatgggagaacattaagatcgttttttttcccttttagctcggtaatctcatgtaccacaggtaatgaccaagcatctctgctagaggatgtaactctcataactcctgtgtaaaatgaggatcctgttggtgatcctcattccagtttccaaagcgagaggagccttctgagcagaagtatgcaagactgattctgtttggaacagtttcctatttggctgcattctaggaggcctcctgacttattcatagtattgtcgcctggtggcattggtgtggggtagcttgtcctgctacttgctaaagttctctttctttgagaaaactgaggaaccagaatgcttagagttcataaaataatctctaaaccatgttaggttaaaacaaaatgaccatctcacaaaaacgagtttagttgaatgctcaattccttacaaaatcttcatttaaggctgagtgtggtggctcatgcctgtaattccagcactttgggaggccgaggcaggaagactgcttgagcccaggagttcaagaccagcctgggcaacgtaggaagactccgtctctacatagaaattttattataaaagtagctggggatggtggcacacacctgtagtcccagctactcaggaggttgaggtgggaagattgcttgagcccaggagtttgaggttgcagtgagctgatcatgccactgcactctagcctaggctacagagcaggaccccatctccaaaaaaaaaaaaaaaaaagtcatttaaaaactgaagaatgttctcttcttgctcagttccctaaattagctggggggattgggatactttacaatttttacatttttaaatttgaagaatttgttttaaacttacttggtaatggcacttctacttactgaccaacttttcagctctttttgaccaggatggttgcaaattagggaaaatatctttatactatacatccaattcaagaggactttaattacttaaaagcatttaggtcataattaaaattattttcactgtttccataaaataagcattatgattgcacactccttctactgtctgaatttatgtaagaggtatagcttgcttaaaatacatatatatgtaaagttatattttcttagaaacatggatgtttacagccattgctttcaaagagattattactgtgtattctccctgttttacaatatgttttcatgaagactatgttacaccagaggcttctgattatcaaagtgataaccagttttaactgccggtatgtaccagatttgtgaactaatttaaaaaaccacaaactatgaataaaatggggtttgcaaact

SEQ ID NO: 1952 - DNA, 5891 bp, Homo sapiens
tcccgcaggaaagcggggctgggggcagcccggcagcgccgctcaacctagtgcgcgcccagttgtttccataggaaccgcgaccgcgccgggcccctccagcggaggcccccgtgcgagcatgcccagtgcaagccgctagtttggctccagtctaggtttccagtaagtggcatgcgggactccggagggatcccaatgagctgagccgagagcctttgtgtgcagagggaggaggaggaggcggcggcggccgccgggctggagaccccgcccggggagcccccagcaggaacaatgctagcctgcctgacccgagggaacttactggacgtcctgcaggagggcttcaatgagcaacagctgcaggcctatgtggcctgggtgaatgcacagctgaagaagaggccagcagtgaagcctgtgcaggacctgcgacaagatctccgggatggggtgatcctggcatatctcatcgagattgttgcaggagaaaagctgagtggggtacagctgagtcccggtaaccaacaggagatgaagaataatgtggagaaagtgctacagtttgtggcctctaaaaagattcgtatgcaccagacttcggctaaagatattgtggatggaaacctgaagtctatcatgaggctggtccttgccttggcagctcatttcaaacctggctccagcaggacggtgaaccaaggacgggactccagagcccctctgcaaagtcaccgaccacactgtgccactgctgttgcccagggagcagctgctgctctggccgatgtgtgtcatgacatgtcccgatcaggacgggatgtctttcgatatagacagaggaacagcagcatggatgaggaaattgagaatccatactggagtgtgcgggccctagtgcagcagtacgaagggcaacaaaggtccccgtctgaatccagctgctccagcctgacttcacccagtccaatccacagtgcaaagagcgagtccattataacccagtcagaagagaaggcagattttgtgattattcccgctgaaggaatagagaacagaacagaagggacagattctccattatctcgagactggcggccagggcctggaacctatctggagacctcatgggaagaacagctgttggaacaacaagaatatttagaaaaagaaatggaggaagcaaagaaaatgatatcaggactacaggccttactgctcaatggatccttacctgaagatgaacaggagaggcccttggccctctgtgaaccaggtgtcaatcccgaggaacaactgattataatccaaagtcgtctggatcagagtatggaggagaatcaggacttaaagaaggaactgctgaaatgtaaacaagaagccagaaacttacaggggataaaggatgccttgcagcagagattgactcagcaggacacatctgttcttcagctcaaacaagagctactgagggcaaatatggacaaagatgagctgcacaaccagaatgtggatctgcagaggaagctagatgagaggaaccggctcttgggagaatataaaaaagagctggggcagaaggatcgccttcttcagcagcaccaggccaagttagaagaagcactccggaaactctctgatgtcagttaccaccaggtggatctagagcgagagctagaacacaaagatgtcctcttggctcactgtatgaaaagagaggcagatgaggcgaccaactacaacagtcacaactctcaaagcaatggttttctccttccaacggcaggaaaaggagctacttcagtcagcaacagagggaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaaagttgcctcactcacagagctctccaactgtcagcagcacctgtactaaagtgctctatttcactgaccggtcacttacgcccttcatggtcaatataccaaagaggttggaggaggtgacgttaaaggattttaaagcagctattgatcgggaaggaaatcaccggtatcacttcaaagcactggatcctgagtttggcactgtcaaagaggagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaattctgtccaaatgtagaccatgggttcatctggagttccttgtccgtgggaacacagtgttctattctactctgaggacaacaaaccgaaggccttaaacgatggggatggatgatcccgcctctgtaggggcatggctgctattatctggaaattaggaattggatgcatcattcctgtgtgttacagtattattttaattggcctcaatggttgcagcaatcagagtcccagcgtttgtactcacagacaaggcaaaggtaccagcttttctgtttctttgaacctactgcaaaccaagaataactcatgaggtggtaccaaagatgaaagcccagacttcagtaatcttttgaaccagacgtggatggtgctgaattgttgcttggatggaaaaagggctgcccatgttgtgctacactatgctaaaactgtaatttagtaagaccttgggctgcctcttctgtcttaactggttctgcagcttgtccttttgcccacatagggcctatttcatgtactgttagttttctctggggactctttaactttagagccatttctttttcttcaaactgatgaacttttgtttgaaaggcataaggagtgaaaagctccttgaaaatccaggcgggtatggaaaggtgctgctacccatatctttttgactttctttgtttcatgactttaactcatggcatctcctttgtagtaaaaggagacagaccattaatttcagcatttctttgtgatttataagtactgagcatgaagtacttgtctgcccctcatttcaaggccagagttattttctatttatgtattagtctaggctgatcttttagggcacaatagaaaccatggggcgtggagcatgagttgtgaatggcagggatcattctgggtaaaaaaaacctagaatcatttctgatgtgcaacattgtcaagtgaagaagctaacagttcaactaccgagattatttgataacctgggttttctcattcatccatcaagcaccatcaaccagtcagccattattatttatatatgtattaccaaaagcagtctatctgcctgtgacctccaatgtacactgccaaacacaagagtaggacacatctgttctgggttcttgacctatctgtctccaattcatctccccttttcagccatttcaacaaactactctttggagctctgagatgacatcttgttgttttatatagatgtatcttttaaaaatagttcacgtttggagaattcttttgtactcatttgctttttgtctgagaaccatgtctatttttataactggagtgtgagttctgtatcttctcacattctgtatactgtatccattttctagagaacccagtagcttttatacagtctcttcttaccaccccttgtggtttcagaacaagctttattttattacgagtatattaatgacaactaattcctgttccaattctacctgttttagttgtgaaggtagttttgtgtaatccagttgattgctcctctggcagagagaaggagctcaaaagatacttgatgtctttcatgtaagtttacctggtcttttcctattgaagaatttttcatcagaaacgactgggaaagtttgggaaagtcagcaaaagaaagaatgcatttcgaaagcaaacagaagaaaaaagtatattctcacagtttttccccaggaagtctggagaaaaagtcctcatgtcaccaatttctctgttgcatgaattttagtgttttgctataagacagcatgagggctatcaggccaaaattcattattgtatttccaatacagtttgtcttgaatgtctgtctcttaaaccagtttttacttgtcagttttctctcagcaaacagtcttactattatgtggaatttaacttttcagagaaaatttccaaagtcctctaccttatttggcttttatctgtgtcttttggaaaaggagctgcatggcctcagtgcctccataaaaagcttaagttgagttcatgggagaacattaagatcgttttttttcccttttagctcggtaatctcatgtaccacaggtaatgaccaagcatctctgctagaggatgtaactctcataactcctgtgtaaaatgaggatcctgttggtgatcctcattccagtttccaaagcgagaggagccttctgagcagaagtatgcaagactgattctgtttggaacagtttcctatttggctgcattctaggaggcctcctgacttattcatagtattgtcgcctggtggcattggtgtggggtagcttgtcctgctacttgctaaagttctctttctttgagaaaactgaggaaccagaatgcttagagttcataaaataatctctaaaccatgttaggttaaaacaaaatgaccatctcacaaaaacgagtttagttgaatgctcaattccttacaaaatcttcatttaaggctgagtgtggtggctcatgcctgtaattccagcactttgggaggccgaggcaggaagactgcttgagcccaggagttcaagaccagcctgggcaacgtaggaagactccgtctctacatagaaattttattataaaagtagctggggatggtggcacacacctgtagtcccagctactcaggaggttgaggtgggaagattgcttgagcccaggagtttgaggttgcagtgagctgatcatgccactgcactctagcctaggctacagagcaggaccccatctccaaaaaaaaaaaaaaaaaagtcatttaaaaactgaagaatgttctcttcttgctcagttccctaaattagctggggggattgggatactttacaatttttacatttttaaatttgaagaatttgttttaaacttacttggtaatggcacttctacttactgaccaacttttcagctctttttgaccaggatggttgcaaattagggaaaatatctttatactatacatccaattcaagaggactttaattacttaaaagcatttaggtcataattaaaattattttcactgtttccataaaataagcattatgattgcacactccttctactgtctgaatttatgtaagaggtatagcttgcttaaaatacatatatatgtaaagttatattttcttagaaacatggatgtttacagccattgctttcaaagagattattactgtgtattctccctgttttacaatatgttttcatgaagactatgttacaccagaggcttctgattatcaaagtgataaccagttttaactgccggtatgtaccagatttgtgaactaatttaaaaaaccacaaactatgaataaaatggggtttgcaaact

SEQ ID NO: 1953 - DNA, 786 bp, Homo sapiens
gcagagggaggaggaggaggcggcggcggccgccgggctggagaccccgcccggggagcccccagcaggaacaatgctagcctgcctgacccgagggaacttactggacgtcctgcaggagggcttcaatgagcaacagctgcaggcctatgtggcctgggtgaatgcacagctgaagaagaggccagcagtgaagcctgtgcaggacctgcgacaagatctccgggatggggtgatcctggcatatctcatcgagattgttgcaggagaaaagctgagtggggtacagctgagtcccggtaaccaacaggagatgaagaataatgtggagaaagtgctacagtttgtggcctctaaaaagattcgtatgcaccagacttcggctaaagatattgtggatggaaacctgaagtctatcatgaggctggtccttgccttggcagctcatttcaaacctggctccagcaggacggtgaaccaaggacgggactccagagcccctctgcaaagtcaccgaccacactgtgccactgctgttgcccagggagcagctgctgctctggccgatgtgtgtcatgacatgtcccgatcaggacgggatgtctttcgatatagacagaggaacagcagcatggatgaggaaattgagaatccatactggagtgtgcgggccctagtgcagcagtacgaagggcaacaaaggtccccgtctgaatccagctgctccaggtaactgtggcctctgaaacctgaattctggaggattctcggagttctcggcttcaa

SEQ ID NO: 1954 - DNA, 6075 bp, Homo sapiens
gtccgcccgggccgtcgcagccgctgccgcggtcccctgcgctcctccccgctgccgccgcacgcccccagccggtcccgcctcgcctcctccgcggcggcggcttccgcccttcttagctgcgctgccggaggaaacggaagaaggagcaagctatggaggggaacagggatgaggctgagaaatgtgtcgagatcgcccgggaggccctgaacgccggcaaccgcgagaaggcccagcgcttcctgcagaaggccgagaagctctacccactgccctcggcccgcgcactattggaaataattatgaaaaatggaagcacggctggaaatagccctcattgccgaaaaccatcaggtagtggcgatcaaagcaagcctaattgcacaaaggacagcacatctggtagtggtgaaggtggaaaaggctataccaaagaccaagtagatggagttctcagcataaacaaatgtaaaaattactatgaagtacttggagttacgaaagatgctggtgatgaagatttgaaaaaagcttatagaaagcttgctttgaagtttcatccagacaaaaaccatgcacctggagcaacagatgcttttaaaaagattggaaatgcttatgctgttttaagtaatccagaaaagcgaaaacagtatgacctcacgggcaatgaagaacaagcatgtaaccaccaaaacaatggcagatttaatttccatagaggttgtgaagctgatataactccagaagacttgtttaatatattttttgggggtggatttccttcaggtagtgtacattctttttcaaatggaagagctggttatagccaacaacatcagcatcgacatagtggacatgaaagagaagaggaaagaggagatggaggtttttctgtgtttatccagctgatgcccataattgtattgatcctcgtgtcattattaagccagttgatggtctctaatcctccttattccttatatcccagatctggaactgggcaaactattaaaatgcaaacagaaaacttgggtgttgtttattatgtcaacaaggacttcaaaaatgaatataaaggaatgttattacaaaaggtagaaaagagtgtggaggaagattatgtgactaatattcgaaataactgctggaaagaaagacaacaaaaaacagatatgcagtatgcagcaaaagtataccgtgatgatcgactccgaaggaaggcagatgccttgagcatggacaactgtaaagaattagagcggcttaccagtctttataaaggaggatgaactggaatttttatttataccttttagcgtactctttattttttctgtaagtaagtttggtttcatcatgagggatgaaggaaaagatttgatactgaaaactaaactgaatagttggttcctgaaatcttggactgtttatgacctactggctcctttaaatagtaactgaaaactaaaatggaatattttagttaacgcttctacaagtattttcattttaaaagcttacatgattcctaactaaagtgtcatgagaaaggattatcacacctgtagcaatttccagttttagtgattctccattttttcccttgtcatgtaaatatttatggaatgatcattttgtgtacatacaggttactgcttttttatttaaattcttttagtgtttagctccatgagacacttcagtttaaattgatggaataaatgttatatgacacatttacattttccttatcaaggtgtcaaatatgtggactttaaacaatgaaactttttcaaaaagaaaaaacaaaaactttaactttgtgtaaaatcttatagtattatcagcttagagggaattgatatttttaatattgccgttatattccaaaatatatattgagataaatgaactggtgtagaatatcagtttgctatttagttttatgaattactatacatatacatgcatagaaatgaaatgctatactgataaattttaaagaaaatatgaggaaatggctataaatattaaactaaaagggtcttcaacagtaaagtgcagttatgtcatttaaaattccaatactttaaaggccaccaaattttgatgtatatgtccttgaagggctgctaaaatttatgaagaggactcacattttcccccatagaaatttgcagtttcttggtgatcatttaagcaggatccaaagaagttcctttacaaataagtaataagaaaaatgagtactaaaatacagctttgtgccttttaaccctatgccaactcctaaacatataagtagattacagtatacttatctgatcagagcatgatctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaagtttttgatgcctgtatactggatatgaaactatttgatttctagtcttctgtgtttagcagttgtaatattttaatgattttgcttcatactcggttaatggaacataaacatatctttgatacttctttgtgagtgagagaatgctagatagggtggctttgttctttgtttaagttttttttcctgaatgtagttaatttatggcatctgttgaataaaactgctaaaatgacctcttaaaaatgttctgttgtatccccttttccaggtgaatcaatagaaatgcctgattgaattagtaggttaaactaaacaacatactgtcataggaaaactggagagcttaaccaacttgctcttagaaatgttaccttaaaaaaaaaaaaaaagcagtgcttaagagaaaatacaattttaattattttgttgagcctgcagagtaagtttttaaaaatataagttcatagcattttaattaactttgaaagttcatatgcatcagaaaatttatgaaaatttgaatgaaaaaaatttcatctatttatttttctaattttaatggcaaatttacactattatggctgataattctgtgaacttaccttcttgttgactgattctttttcccttaatcccagctttaaggagataggtgaagttattgtacaaagttaagtgataccataaagtatatattataaagtcatacatggcttttggacagtattatatttcagttgcagtgctgcattccattaaatttcataaaatgctagggaaaatgtgtttgataaaattttctgcagtgagaaatgacagactgagtgcctgacaatttaagccacatatgaagtatgcaagtaaagattcagtccttaatgtcatctatatcatggtataaaagctcaacaagtatcttataatttggagttaactttataaagtaagaagagtttggatatcttgataaaagattttcatgtttgctgctttttttataataaaaatcccaacattttgccatcttatgtttagctacatgaacttcgcaatttcatcggctcattctaatgaccacctaaaagtcctcaatctttgaatattgctttattagctcctctaactggtattctaacagtttagcagcacttatatttattaatgctttacatttttacccctttttgtgtaaacacaaatacacccatgcatatacacacaaacattattgtccttgtgagggtttgggggaaatgaaaaatagtacctttctcctcttcttttgattccttagttcccaaatagactggtgctagtcatttagtcatctgtaaatttcgaaatgtagtttgattaaatgtgaactgaattctcagcaatgaaaaatgtcaagttgaattcatctaataagtgaaaataatatattttgtaaacagattacatttgaacacctaaataagtatttgtttcataatcattacatgcttgtttatgatttacaaagatttggtagagaaaagtacagtccttaaggcatatatatgccaatgcattaaactactcagcttttgtgccagctcaggtgttcataggaacaggaatgtggaataccagctttttactttaattatacttttatgctgaatttttcttccagttaaacctttaattacactagtatgtaaagtagttactgagaaaaataagtttttgatttcccttctgttgatctgtaacatttttaaatgaagctatttaacacatgacatgctaatgttacttaatggattcctatgtatttcattaaaaaaaagtctcccacctgtgttaagacagctaaatatttcttgatgttggcttgaggaccaagtgagccatcttgccagttaagcaagttttatatcagaggaccaaatggttaagaagagaatttgtacatttcttgagcttccccatgtgaagcttgggttcagtactatcctattactatccatcttcataatgagtgaagcaaactgaaagggaattcataatcttttttcttatctgaacagaaaaactaatgaaaatcaacaataaatctttattttaattttcattcaacagctgaaaaaccatgtctgttgaccacattggaccattgcctagttaaaatccataaaattccctataaaccaatgaaaagaaacttgtctggcaataatttccaacattttaaattctaatttttagttacaaagaaaaaggatagaatgaggcttttcaaggaattcttgctcatcccttcaattatttggcaggtaaaacagtcctagaattcagcttcctttttggttttattactattaaatagatactttcatataaatggaaacacttttcctcaaaacattaattcaaaacatactccttatattaaggattatagcaccatattttttgtatattccctatgtgtaactttttcctgttggtatgtgatatttttcatttaatatgactatctgctggtgttggggccaatagatttgtgaatattctgtggatgtgtctatgtataggtgtatatatatatatatatatttttttttttttttcccagctaattacctcaaatgtgtgattgtttaatatataccacactatgtttgcacagagcagggcttccattagcagtggatatttttatgtctgactttgaaaatcagtcaacacaatttcattggtgtgaattatttgttgctctttttcatattttaatggagagattcctattataaggcccatgcttcaaacataattatatctttctatatccagccatctggaaatacataggggtaagaagtatttcttgaaatgtccttgtttagtaagttagtaaaaactgggatgactagttgccaagatgtcttgtaactgcatagcagatgacacctggcatggcaagtctcattcacttcagcacaacactctgtacatttcagtctgatattctactttgccatttaaggacaccattaaaatcatagagattttcagtgacattggagtattgtaattattactttcaaaaaattatttttaataggatgattaaaccaatgagaagaaacacacataaatgatattttgcagtttatctgtattaagaaatgcttcttgccaatttctagttttagtttttggattgctacataagactttctttccatttactttatgtgtttttaaaagctgcaggtaatttttaaggtttgatggaattataatggaagccttgtataagttaaatgaaattggtaaaggagagcttactttgtctataatgcattcaggattaaaaattagatttcaaaatgaaatgtctgatttgtaaaatatttaatgttatatcagacttacataaaattttctgtgagaactcaaatgcatttgatttttaatgaatgttctgaatgaaatatgaatttttgtctttcagtctctgtagtttatctcaatatattaataaaaaggtctgttctcactgtaaaa

SEQ ID NO: 1955 - DNA, 2988 bp, Homo sapiens
agagacacgtagtgaaaatgggaggatctagaaggaggctgtctcctgtgtagtgtatatttatctgtaagtgagccgttggggaaggattgaatacagagacgctgtctgcttgctgccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaagggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatatagtggttgtaccaaacggatgaagatttctcgaaaaaggctaaacgctgatggaaggagttacagatctgaggacaaaattcttaccattgagattaaaaaagggtggaaagaaggcaccaaaattacttttccaagagaaggagatgaaacaccaaatagtattccagcagacattgtttttatcattaaagacaaagatcatccaaaatttaaaagggatggatcaaatataatttatactgctaaaattagtttacgagaggcattgtgtggctgctcaattaatgtaccaacactggatggaagaaacatacctatgtcagtaaatgatattgtgaaacccggaatgaggagaagaattattggatatgggctgccatttccaaaaaatcctgaccaacgtggtgaccttctaatagaatttgaggtgtccttcccagatactatatcttcttcatccaaagaagtacttaggaaacatcttcctgcctcatagaatgaagaactttgttacacatattttgataaggcactgaaaatataaaaggactggtagtttactgatgtagatgtgaattctgtataaagatgtgtaaattcttttgagggttcattaaattgcatgaatagagacgggtcaaataaataggcaaaagggatttttacagttagagataaaagagaaaaccattcactgtattttatttcatttctcctgattcagatatttttagtaatttgcttatatgtaaaagttgtttttgtggagtcagtggatatatttctaatgaagtgctagactatccaattacttaatttcttatacctttagataatcagtatgaaaagttcccatttataatggaaatgaaaattcttaactaaactatacatgtaatatgtatttctagaagagaataaaaacccaagtcagttattagatttaaatcaccttctgaaatgctgctatagggctggtatctgtaaaagaatatcctgatgcatctgtttcaccattttgatttttaaagtatgctgtagcatttcttaataacatcgttgtgatgttcttaaggcagatctttcttcataaaaaggaaagtaatggcaatttctctcctgtggaaatcccaattgcttgaattactgatattttagaatagactttttaaaatgccatatgtaattttatgcaagttgactatatatcttgtacttaataaattataggctcattttgttctctgctagtttaaagtaattcgtttaataatagatgtgtttttagaggaaatgctgttacttggaattaattttccagttatacagtcttctataacttactaataatattctatatgtactttatgtaatttccctaaaaagaatgaactaccactacactatggtgttaaaccaaaatatagggaaaataaacactaactgctgcttatggataatgttgcaactacttgttatgcatataaatattttactttttcacatgtatagattgcatttcttaggtgttttaattttttaaatatatttatgttttaaaaatttagttttgttttctgttttataactatagtgagaatgatgttttgaagcaaaatttttggttataaaatagttttcaggattatatatatatatactggatcctatcgccttttagtagaatatgaaatattcttttagaaatccaatataaataggttataatagccatattctttattactttattgagatataatttacatgccataaagtttacccttaaaatatataattcagtggtttttagtgatatttacaaagtggtacaatcatcatcactttctaattccagaatattttcatcaccccaaaaagaaatcctaaatccattagcagttacttcccattcttcccttcctccagcccctgaaaacactaccatctacttttcatctgtatggatttgtctgttctggacatttcacataaatagactcaaacaatatatggctttttttttttttggtctggcctctttcatttagcttaatgttttcaaggttcatctatgttgtatcacgtatcagtactttattttttgtgtggcacgtcatatggatataccacaatttgtttatcttttcattaattatgggcatttggcttatttctacttttttggctattataaataatgctgctgtgaa

SEQ ID NO: 1956 - DNA, 686 bp, Homo sapiens
gttaaggtctcttaagttaagaacagcattgtttcttgaccaaaatagattttgtagcttcttaggcgtagtttctcccaccccatcctgtgggtactcaaatgtaagatcatattctgaattgtcatcacaggactagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaagggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatat

SEQ ID NO: 1957 - DNA, 2268 bp, Homo sapiens
gcgcggctgagtgctgcagaatcgctggggtggcagagccgccagcgaggctggggatgggggcgccgctgctctctcccggctggggagccggggctgccggccggcgctggtggatgctgctggcgcccctgctgccggcgctgctgctggtgcggcccgcgggggccctggtggaggggctctactgcggcacgcgggactgctacgaggtgctgggcgtgagccgctcggcgggcaaggcggagatcgcgcgggcctaccgccagctggcccggcgctaccaccctgaccgctaccggccccagcccggagacgagggccccgggcggacgccgcagagcgccgaggaggctttcctgctggtggcaaccgcctacgagacactcaaggatgaagaaacacgaaaagattatgattacatgctggatcatccagaagagtactacagccattactaccactactatagcaggcgcttggcccctaaggtggatgttagagtagtgattttggtcagcgtgtgtgctatttcggtgtttcagtttttcagctggtggaatagctacaataaggcaatcagctacctagccacagtgcccaagtaccgtatccaagctacagagattgccaagcagcagggactgctcaaaaaagccaaagaaaaaggcaaaaacaaaaagtccaaagaagaaattcgtgacgaggaggagaacatcataaagaacattataaaaagtaaaatagatataaaggggggctatcagaaaccccaaatctgtgatcttctcctgtttcaaattatcttagctccttttcacctatgctcatatatagtttggtattgtcggtggatctataattttaacatcaaaggcaaagaatatggagaggaagagagattatacattatacgtaaatctatgaagatgtcaaagtctcaatttgatagtctagaagatcatcagaaagaaacttttcttaaacgagagctctggatcaaggagaattatgaggtctacaagcaagaacaagaggaagaattaaagaaaaagttggcaaatgaccccagatggaagagatacaggagatggatgaagaatgaagggcctgggcggttaacatttgtggatgactgaagattgatggaatgctactatgccaaaccttaattgtgatattattttcataactgaattattttagaaatgtatcaattgactgctgctcagcagtaactaaaattcctcaagtatttgattaaacagaataatgtcaaaatttaaaccttcccttaaaactttatacataagacatttatgattgttcaatttttataatctatttgtggattttgttaaaagatttcacatgaagatttattagttgccatttaaaatttttatatgtttagttaaaagatttgacatgaaaatttattagataccatttaaaaattttatgtgttatgtgtttattctttgagaatgttaccttactgtttgtaatagtgctacatttttctgctttcatggcctctgtattttcacaaaacaccaaaaacagcatttaattatattatcatgagtgtgtttctggacacaaacttctgcagtagaatgacctaacatgtcgttttcattgcagtcattataggattgaaatacgttcaaaataacctctctaggaaagtcttctgctagaatttctcccctctattcattataatattctttgtttttaaagccagtcaaatataatagtcttaataagatcagaaactctccaggagagtgagtctaccctcacgtccttgtaggatgatcttgattatagtcttattataggactataactgtattctcaacatttctccagaaaggaccttgtaaaaaggtcttttgtaccacagtattggttttttcccctctctcttcacttaaaaaaaaaaatagcaaggcagaaatagtgtattgaaaagttgttcatctattatgaagtccttgagtggtgaaaaatccgttgtacatgagaacatttctatgcatttaagccagaaacgaggtacatggctgtgtgctcttctgtcaaccaatgaaatgtgttttcacatgtgtggcagtgcaagtaaataacacattatttgactgaatcaggcatgatactgcaccaaagtgttggtacatattcacggtagtaaatcagtacccctgttaaaggatttatcccattgcttcatattaataaaatggttacaatatatcacaa

SEQ ID NO: 1958 - DNA, 1447 bp, Homo sapiens
agagccgccagcgaggctggggatgggggcgccgctgctctctcccggctggggagccggggctgccggccggcgctggtggatgctgctggcgcccctgctgccggcgctgctgctggtgcggcccgcgggggccctggtggaggggctctactgcggcacgcgggactgctacgaggtgctgggcgtgagccgctcggcgggcaaggcggagatcgcgcgggcctaccgccagctggcccggcgctaccaccctgaccgctaccggccccagcccggagacgagggccccgggcggacgccgcagagcgccgaggaggctttcctgctggtggcaaccgcctacgagacactcaaggtctctcaggcagctgcagagcttcaacagtactgtatgcagaatgcctgcaaggatgccctgctggtgggtgttccagctggaagtaaccccttccgggagcctagatcctgtgctttactctgaagactcgagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttttgtttatttaaacaactgaatacttataaactgttgttcctggaagttatttattccataaaaaatttgttcttttgtcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttacgtttctctgctttgtagttgtggctgtacttaaagaaatacagaatttcatatatttaaaaatgtttaaaatgtgacccacagaacattgtaaatgattaaaaactaacatgaaaatattacaacctaaaagaattcttaacttcacaagtgttttacttcgacgatgtgcctttgatttaatttgggacacttttttagaaggatacattattcgtgtttgcaacggtctttgaagagcttggaaataaaatttctgcttaattaatc

SEQ ID NO: 1959 - DNA, 1013 bp, Homo sapiens
gaggcctgggataggctgaggcgaagggaagcctcacccactgtgcagcccaggcgccgggcgctgcctctacagctgtgtgtaggcctgggggcgagggtcttcggaacgtagcgctggctgcggccccgcccgcctacccacccgcccgtccggcagccggctcccgccgcctccgcgctctgtctggggccagccacctggcgggccgctccggtgcgcctgcccgcgcttttcactgacaggcgctgttccccacagccagcgccgcccgccacgtcccagctctcggccaacggagctgcgcggcgggtgacctttccgagcccagcgcgatgacggctccttgctcccagccggcgcagcttcctggacgccgccagctcgggctggtgccgttcccgccgccgccgccgcggacgccgctgctgtggctgctgctgctgctgctggccgccgtggcgccggcgcgcggctgggagagcggagacctggagttgtttgacttagtggaggaggtgcagctcaacttctaccagttcctcggggtgcagcaggatgcatcatctgcagacatcagaaaagcatatcgtaagctttcactaactttacatccagacaagaataaagatgaaaatgcagaaactcagtttagacaagtatgatgatattctgatcaatggacttccagattggcgacagcctgtattctactacaggcgggtgagaaaaatgagcaatgctgagctggcattactcttgttcattattctcacagtgggtcattatgctgtggtttggtcaatctacctggaaaaacaactggtaagtgttagtaataaatcaaatgaactagcctccttaattttatatggaattttggacatttatttttcaactgatgaaaatttctgtttctctctgtatacttctcattctaatagttttatactcaatgtttgacatatttctaagtcaagaagaacccatgaaataagaaaatattcttcttt

SEQ ID NO: 1960 - DNA, 2106 bp, Homo sapiens
gcagcccaggcgccgggcgctgcctctacagctgtgtgtaggcctgggggcgagggtcttcggaacgtagcgctggctgcggccccgcccgcctacccacccgcccgtccggcagccggctcccgccgcctccgcgctctgtctggggccagccacctggcgggccgctccggtgcgcctgcccgcgcttttcactgacaggcgctgttccccacagccagcgccgcccgccacgtcccagctctcggccaacggagctgcgcggcgggtgacctttccgagcccagcgcgatgacggctccttgctcccagccggcgcagcttcctggacgccgccagctcgggctggtgccgttcccgccgccgccgccgcggacgccgctgctgtggctgctgctgctgctgctggccgccgtggcgccggcgcgcggctgggagagcggagacctggagttgtttgacttagtggaggaggtgcagctcaacttctaccagttcctcggggtgcagcaggatgcatcatctgcagacatcagaaaagcatatcgtaagctttcactaactttacatccagacaagaataaagatgaaaatgcagaaactcagtttagacaattggtggccatttatgaagttttaaaggatgatgaacgaaggcagaggtatgatgatattctgatcaatggacttccagattggcgacagcctgtattctactacaggcgggtgagaaaaatgagcaatgctgagctggcattactcttgttcattattctcacagtgggtcattatgctgtggtttggtcaatctacctggaaaaacaactggatgaactactaagtagaaaaaagagagaaaagaaaaaaaagactggcagcaagagtgtggatgtatcaaaactcggtgcttcagaaaaaaatgaaagattgctgatgaaaccacagtggcatgatttgcttccatgcaaactggggatttggttttgccttacactaaaagcattacctcacctcatccaggatgctgggcagttttatgctaaatataaagaaacaagattgaaggaaaaggaagatgcactgactagaactgaacttgaaacacttcaaaaacagaagaaagttaaaaaaccaaaacctgaatttcctgtatacacacctttagaaactacatatattcagtcttatgatcatggaacttccatagaagaaattgaggaacaaatggatgattggttggaaaacaggaaccgaacacagaaaaaacaggcacctgaatggacagaagaggacctcagccaactgacaagaagtatggttaagttcccaggagggactccaggtcgatgggaaaagattgcccacgaattgggtcgatctgtgacagatgtgacaaccaaagccaagcaactgaaggattcagtgacctgctccccaggaatggttagactctccgaactcaaatcgacagttcagaattccaggcccatcaaaacggccaccaccttgcccgatgacatgatcacccagcgagaggacgcagagggggtggcagcggaggaggagcaggagggagactccggtgagcaggagaccggggccactgatgcccggcctcggaggcggaagccagccaggctgctggaggctacagcgaagccggagccagaggagaagtccagagccaagcggcagaaggactttgacatagcagaacaaaacgagtccagcgacgaggagagcctgagaaaagagagagctcggtctgcagaggagccgtggactcaaaatcaacagaaacttctggaactggcgttgcagcagtacccaaggggatcctctgaccgctgggacaaaatagccagatgtgtcccgtccaagagcaaggaagactgtatcgctaggtacaagttgctggttgaactggtccaaaagaaaaaacaagctaaaagctgaatattctgggagatgatgttcaccttcattttccaaaatgaatatcttaaaaatcttatgcagaaatttgcattttgtacctcaatatttctacgtcatgtgccttagtaaaaaaaaataataaataaataaaagatgagtgttgtgcta

SEQ ID NO: 1961 - DNA, 363 bp, Homo sapiens
tggacgccgccagctcgggctggtgccgttcccgccgccgccgccgcggacgccgctgctgtggctgctgctgctgctgctggccgccgtggcgccggcgcgcggctgggagagcggagacctggagttgtttgacttagtggaggaggtgcagctcaacttctaccagttcctcggggtgcagcaggatgcatcatctgcagacatcagaaaagcatatcgtaagctttcactaactttacatccagacaagaataaagatgaaaatgcagaaactcagtttagacaattggtggccatttatgaagttttaaaggatgatgaacgaaggcagaggatgaactactaagtagaaaaaagaga

SEQ ID NO: 1962 - DNA, 2210 bp, Homo sapiens
gacggctccgggccgccaggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggtgtttctctcaaagtcaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcttgctgaaatattactgcttgaatctggagcagattgcgggtttataaaactgctttttatctgagaacaaa

SEQ ID NO: 1963 - DNA, 1357 bp, Homo sapiens
gcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcaga

SEQ ID NO: 1964 - DNA, 1793 bp, Homo sapiens
aagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggtgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggta

SEQ ID NO: 1965 - DNA, 3311 bp, Homo sapiens
gacggctccgggccgccaggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggtgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcttgctgaaatattactgcttgaatctggagcagattgcgggtttataaaactgctttttatctgagaacaaacgggtttggaaattagtcgtcttttttccccactcccagagctgctcaagtcattccaccggccccctcggcttgggacagggtagtgtaactcccgatcccagggcctagccctgacacaggtggcttcccgtatcccggtgggaaaacgccctgccaccagcgggcttgagctggcctgtgtccctccaccgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcaga

SEQ ID NO: 1966 - DNA, 975 bp, Homo sapiens
agatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagagaatgacagactgcctcatcatcgggttgattgacatatgccagagatgtagtccccagccagcctctgcttcctgtcgtctctgctgctgccatgtcacactcctagaactgtatatccctgtcccttctagaacgacagcagtgtcttcatttcctatatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactg

SEQ ID NO: 1967 - DNA, 1357 bp, Homo sapiens; identical to SEQ ID NO: 1963

SEQ ID NO: 1968 - DNA, 1961 bp, Homo sapiens
cagagacccaaacgttcattcattggatagcagcacttcccagcaaaacccagtccctattgatgcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggtgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgt

SEQ ID NO: 1969 - DNA, 3330 bp, Homo sapiens
tggaagtaggcccaggtcgccggcggccgcggggacggaaggcggaagcagagcgtgagcgggaggcggagccgggagagcggctctcgtagctcaccctggccccaggccgggcggctcgagggggaggagttaccgccgttcttcggcatcagaacacaccatgatggctgtgacctaagaccctcaggaagccccggggtcatggcccagaagcaccccggagaaagagggttgtatggagcccaccacagtggtggtgcctccctcaggactttaggaccctccgtggaccctgaaataccttcattctcaggactcagggactcagcagggactgctcctaatggtacccgctgcctcacagagcactctggtcctaagcacacacagcacccaaacccagcccattggttggacccaagccatggccccccagggggtccaggaccacctagagatgcagaggaccctgatcagagtgagacgtcttcagaagaagaatcaggagtggaccaggaactctcaaaagaaaacgagactgggaaccagaaggatgggaactcttttctttccattccatctgcttgcaactgccagggaacacctggaattccagaagggccttactctgagggaggaaatggttcttctagcaacttttgccaccactgtacctctccagctttgggggaagatgagttggaagaggaatatgatgatgaagaatctctcaagttccccagtgatttttcacgtgtgtccagcggaaagaaacccccatcccggagacagcggcaccgctttccaacgaaggaggatactcgggagggtggacgtagggatcccaggtcccctggtcgacatcggctgggtcggaaacgaagtcaggcagataagcgcaaaggcctgggattgtggggagccgaggaactatgtcaacttggacaggcaggcttttggtggctgattgaactgctggtattggtgggagagtacgtagaaacttgtggccatctcatctatgcctgcaggcaactgaaaagcagtgatttggacctttttcgagtttggatgggagtgtggacagggcggttagggggctgggcccaggtcatgtttcagtttctaagccaggggttttactgtggagtaggactgtttactcgttttcttaagctgctgggtgctttgctgctcctggctctggccctctttttgggctttctacagttgggatggcggtttctggtgggactaggtgaccggttaggctggagggataaggctacctggctcttctcttggctggattctccagccttgcagcgttgcttgactctgctgagagatagcaggccatggcagcggctggtaagaatagttcagtggggctggctggagttgccttgggtcaagcagaatattaataggcaggggaatgcacctgtagctagtgggcgctactgccagcctgaagaggaagtggctcgactcttgaccatggctggggttcctgaggatgagctaaaccctttccatgtactgggggttgaggccacagcatcagatgttgaactgaagaaggcctatagacagctggcagtgatggttcatcctgacaaaaatcatcatccccgggctgaggaggccttcaaggttttgcgagcagcttgggacattgtcagcaatgctgaaaagcgaaaggagtatgagatgaaacgaatggcagagaatgagctgagccggtcagtaaatgagtttctgtccaagctgcaagatgacctcaaggaggcaatgaatactatgatgtgtagccgatgccaaggaaagcataggaggtttgaaatggaccgggaacctaagagtgccagatactgtgctgagtgtaataggctgcatcctgctgaggaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcctgagtagctgggattacaggcacacaccaccacacctggcccagctaattcttttttgtatttttagtagagacggggtttcaccatgttgcccaggctggtctcgaactcctgagctcaggtgatccacccgtcttggcctcccaaagtgctggattacaggcataagccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagagaacaagaaagcatgtagccctaatgataggagattatcgcatagagttcagagactggaaactgaattttccctcgactttcactttgtgggtaaatcacccaattttaggctcttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataactggcaacctgtatcttccctctttgttgccc

SEQ ID NO: 1970 - DNA, 2774 bp, Homo sapiens
agagaattggagtattgtctcctggagaaccgggtggtcgggatcgtggaccagggaaggggcttttgctggtcggggagcgccaactgggggttcatgggtggaaaaactttcggatcaagacggggtataaggctagaggcgtgtgcagaggaggggaccgacggaacggggacccaactgggtctacgtgggggcgggggcgcttgtggacgtccaccaaatagcttggtatgcagatgagatgtcaagcagcaggtagatgagttcagtgttctttggctcacgggcaaagttctgagccgagccaagttacgctcccagttcctaggcaccgctcggtgatcgggcctggggagctgcgacccgaggggcggatccaggcatcagaacacaccatgatggctgtgacctaagaccctcaggaagccccggggtcatggcccagaagcaccccggagaaagagggttgtatggagcccaccacagtggtggtgcctccctcaggactttaggaccctccgtggaccctgaaataccttcattctcaggactcagggactcagcagggactgctcctaatggtacccgctgcctcacagagcactctggtcctaagcacacacagcacccaaacccagcccattggttggacccaagccatggccccccagggggtccaggaccacctagagatgcagaggaccctgatcagagtgagacgtcttcagaagaagaatcaggagtggaccaggaactctcaaaagaaaacgagactgggaaccagaaggatgggaactcttttctttccattccatctgcttgcaactgccagggaacacctggaattccagaagggccttactctgagggaggaaatggttcttctagcaacttttgccaccactgtacctctccagctttgggggaagatgagttggaagaggaatatgatgatgaagaatctctcaagttccccagtgatttttcacgtgtgtccagcggaaagaaacccccatcccggagacagcggcaccgctttccaacgaaggaggatactcgggagggtggacgtagggatcccaggtcccctggtcgacatcggctgggtcggaaacgaagtcaggcagataagcgcaaaggcctgggattgtggggagccgaggaactatgtcaacttggacaggcaggcttttggtggctgattgaactgctggtattggtgggagagtacgtagaaacttgtggccatctcatctatgcctgcaggcaactgaaaagcagtgatttggacctttttcgagtttggatgggagtgtggacagggcggttagggggctgggcccaggtcatgtttcagtttctaagccaggggttttactgtggagtaggactgtttactcgttttcttaagctgctgggtgctttgctgctcctggctctggccctctttttgggctttctacagttgggatggcggtttctggtgggactaggtgaccggttaggctggagggataaggctacctggctcttctcttggctggattctccagccttgcagcgttgcttgactctgctgagagatagcaggccatggcagcggctggtaagaatagttcagtggggctggctggagttgccttgggtcaagcagaatattaataggcaggggaatgcacctgtagctagtgggcgctactgccagcctgaagaggaagtggctcgactcttgaccatggctggggttcctgaggatgagctaaaccctttccatgtactgggggttgaggccacagcatcagatgttgaactgaagaaggcctatagacagctggcagtgatggttcatcctgacaaaaatcatcatccccgggctgaggaggccttcaaggttttgcgagcagcttgggacattgtcagcaatgctgaaaagcgaaaggagtatgagatgaaacgaatggcagagaatgagctgagccggtcagtaaatgagtttctgtccaagctgcaagatgacctcaaggaggcaatgaatactatgatgtgtagccgatgccaaggaaagcataggaggtttgaaatggaccgggaacctaagagtgccagatactgtgctgagtgtaataggctgcatcctgctgaggaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcc

SEQ ID NO: 1971 - DNA, 3416 bp, Homo sapiens
ccctccaattctttcccgtgtgtgtggggggacccaggttgcctactgctctagtccaggaccagagacccccaactatatagcagtggaagtaggcccaggtcgccggcggccgcggggacggaaggcggaagcagagcgtgagcgggaggcggagccgggagagcggctctcgtagctcaccctggccccaggccgggcggctcgagggggaggagttaccgccgttcttcggcatcagaacacaccatgatggctgtgacctaagaccctcaggaagccccggggtcatggcccagaagcaccccggagaaagagggttgtatggagcccaccacagtggtggtgcctccctcaggactttaggaccctccgtggaccctgaaataccttcattctcaggactcagggactcagcagggactgctcctaatggtacccgctgcctcacagagcactctggtcctaagcacacacagcacccaaacccagcccattggttggacccaagccatggccccccagggggtccaggaccacctagagatgcagaggaccctgatcagagtgagacgtcttcagaagaagaatcaggagtggaccaggaactctcaaaagaaaacgagactgggaaccagaaggatgggaactcttttctttccattccatctgcttgcaactgccagggaacacctggaattccagaagggccttactctgagggaggaaatggttcttctagcaacttttgccaccactgtacctctccagctttgggggaagatgagttggaagaggaatatgatgatgaagaatctctcaagttccccagtgatttttcacgtgtgtccagcggaaagaaacccccatcccggagacagcggcaccgctttccaacgaaggaggatactcgggagggtggacgtagggatcccaggtcccctggtcgacatcggctgggtcggaaacgaagtcaggcagataagcgcaaaggcctgggattgtggggagccgaggaactatgtcaacttggacaggcaggcttttggtggctgattgaactgctggtattggtgggagagtacgtagaaacttgtggccatctcatctatgcctgcaggcaactgaaaagcagtgatttggacctttttcgagtttggatgggagtgtggacagggcggttagggggctgggcccaggtcatgtttcagtttctaagccaggggttttactgtggagtaggactgtttactcgttttcttaagctgctgggtgctttgctgctcctggctctggccctctttttgggctttctacagttgggatggcggtttctggtgggactaggtgaccggttaggctggagggataaggctacctggctcttctcttggctggattctccagccttgcagcgttgcttgactctgctgagagatagcaggccatggcagcggctggtaagaatagttcagtggggctggctggagttgccttgggtcaagcagaatattaataggcaggggaatgcacctgtagctagtgggcgctactgccagcctgaagaggaagtggctcgactcttgaccatggctggggttcctgaggatgagctaaaccctttccatgtactgggggttgaggccacagcatcagatgttgaactgaagaaggcctatagacagctggcagtgatggttcatcctgacaaaaatcatcatccccgggctgaggaggccttcaaggttttgcgagcagcttgggacattgtcagcaatgctgaaaagcgaaaggagtatgagatgaaacgaatggcagagaatgagctgagccggtcagtaaatgagtttctgtccaagctgcaagatgacctcaaggaggcaatgaatactatgatgtgtagccgatgccaaggaaagcataggaggtttgaaatggaccgggaacctaagagtgccagatactgtgctgagtgtaataggctgcatcctgctgaggaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcctgagtagctgggattacaggcacacaccaccacacctggcccagctaattcttttttgtatttttagtagagacggggtttcaccatgttgcccaggctggtctcgaactcctgagctcaggtgatccacccgtcttggcctcccaaagtgctggattacaggcataagccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagagaacaagaaagcatgtagccctaatgataggagattatcgcatagagttcagagactggaaactgaattttccctcgactttcactttgtgggtaaatcacccaattttaggctcttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataactggcaacctgtatcttccctctttgttgccc

SEQ ID NO: 1972 - DNA, 2853 bp, Homo sapiens
ccaagccatggccccccagggggtccaggaccacctagagatgcagaggaccctgatcagagtgagacgtcttcagaagaagaatcaggagtggaccaggaactctcaaaagaaaacgagactgggaaccagaaggatgggaactcttttctttccattccatctgcttgcaactgccagggaacacctggaattccagaagggccttactctgagggaggaaatggttcttctagcaacttttgccaccactgtacctctccagctttgggggaagatgagttggaagaggaatatgatgatgaagaatctctcaagttccccagtgatttttcacgtgtgtccagcggaaagaaacccccatcccggagacagcggcaccgctttccaacgaaggaggatactcgggagggtggacgtagggatcccaggtcccctggtcgacatcggctgggtcggaaacgaagtcaggcagataagcgcaaaggcctgggattgtggggagccgaggaactatgtcaacttggacaggcaggcttttggtggctgattgaactgctggtattggtgggagagtacgtagaaacttgtggccatctcatctatgcctgcaggcaactgaaaagcagtgatttggacctttttcgagtttggatgggagtgtggacagggcggttagggggctgggcccaggtcatgtttcagtttctaagccaggggttttactgtggagtaggactgtttactcgttttcttaagctgctgggtgctttgctgctcctggctctggccctctttttgggctttctacagttgggatggcggtttctggtgggactaggtgaccggttaggctggagggataaggctacctggctcttctcttggctggattctccagccttgcagcgttgcttgactctgctgagagatagcaggccatggcagcggctggtaagaatagttcagtggggctggctggagttgccttgggtcaagcagaatattaataggcaggggaatgcacctgtagctagtgggcgctactgccagcctgaagaggaagtggctcgactcttgaccatggctggggttcctgaggatgagctaaaccctttccatgtactgggggttgaggccacagcatcagatgttgaactgaagaaggcctatagacagctggcagtgatggttcatcctgacaaaaatcatcatccccgggctgaggaggccttcaaggttttgcgagcagcttgggacattgtcagcaatgctgaaaagcgaaaggagtatgagatgaaacgaatggcagagaatgagctgagccggtcagtaaatgagtttctgtccaagctgcaagatgacctcaaggaggcaatgaatactatgatgtgtagccgatgccaaggaaagcataggaggtttgaaatggaccgggaacctaagagtgccagatactgtgctgagtgtaataggctgcatcctgctgaggaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcctgagtagctgggattacaggcacacaccaccacacctggcccagctaattcttttttgtatttttagtagagacggggtttcaccatgttgcccaggctggtctcgaactcctgagctcaggtgatccacccgtcttggcctcccaaagtgctggattacaggcataagccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagagaacaagaaagcatgtagccctaatgataggagattatcgcatagagttcagagactggaaactgaattttccctcgactttcacttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataactggc

SEQ ID NO: 1973 - DNA, 744 bp, Homo sapiens
aggaaacgaatggcagagaatgagctgagccggtcagtaaatgagtttctgtccaagctgcaagatgacctcaaggaggcaatgaatactatgatgtgtagccgatgccaaggaaagcataggaggtttgaaatggaccgggaacctaagagtgccagatactgtgctgagtgtaataggctgcatcctgctgaggaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgccaatgggaacttctttgcagctcctcagcctgcccctggagccgctgcagcctctaagcccaacagcacagtacccaagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccag

SEQ ID NO: 1974 - DNA, 756 bp, Homo sapiens
gacggaaggcggaagcagagcgtgagcgggaggcggagccgggagagcggctctcgtagctcaccctggccccaggccgggcggctcgagggggaggagttaccgccgttcttcggtacgtccgtcttttttttttttttcgtttttttttgtttttttgagatggagtctcgctctgtcacccagactggagtacagtggcacgatctcggttcactgcaacctccacctcccgggttcaagcgattcttctgcctcagcctcccgagtagctgggactacaggtgcgcgccaccacgcctggcgaatttctgtatttttagtagagacggagtttcaccatgttggccaggctggtctcgaactcctgacctcgtgatccgccggcctcggcctcccaaagtgctgggattacaggcgtgagccacggtgcccggccaccttcgtcccttctacacagccggcatcagaacacaccatgatggctgtgacctaagaccctcaggaagccccggggtcatggcccagaagcaccccggagaaagagggttgtatggagcccaccacagtggtggtgcctccctcaggactttaggaccctccgtggaccctgaaataccttcattctcaggactcagggactcagcagggactgctcctaatggtacccgctgcctcacagagcactctggtcctaagcacacacagcacccaaacccagcccattggttggacccaagccatggccccccaggg

SEQ ID NO: 1975 - DNA, 638 bp, Homo sapiens
gtgcgcgcggtggggggaggaggggtgacatcacaaggcaggcccctccaattctttcccgtgtgtgtggggggacccaggttgcctactgctctagtccaggaccagagacccccaactatatagcaggcatcagaacacaccatgatggctgtgacctaagaccctcaggaagccccggggtcatggcccagaagcaccccggagaaagagggttgtatggagcccaccacagtggtggtgcctccctcaggactttaggaccctccgtggaccctgaaataccttcattctcaggactcagggactcagcagggactgctcctaatggtacccgctgcctcacagagcactctggtcctaagcacacacagcacccaaacccagcccattggttggacccaagccatggccccccagggggtccaggaccacctagagatgcagaggaccctgatcagagtgagacgtcttcagaagaagaatcaggagtggaccaggaactctcaaaagaaaacgagactgggaaccagaaggatgggaactcttttctttccattccatctgcttgcaactgccagggaacacctggaattccagaagggccttactctgagggaggaaatggttcttctagc

SEQ ID NO: 1976 - DNA, 2538 bp, Homo sapiens
ggtcaggaaagctcaggcaagcccaccctcaggcactacagctagactccgagcttactgggcagtcatctgattcgaccaacatcagttcgcagggcttaagcccagtcccttacggcggcctggggagggaccaggcccaagtatataaagctccctgagggtccgcgttggctttgcgcctgtgagtgtgattcaagaacgtcccagtgcccttggctcctttcggagtgtgaccccgtgcttgcacgggacacgttacccagctcgggtgagaagggtatcttccgggaacctcgcctttaatagcacaacgagcgcagagtccactggatctgcgagaagaaaccgcgctaactagtttgtccctacggccgcctcgtagtcactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagagactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatcttttaaagatctccttaaattctataactgatcttttttcttattttgtttgtgacattcatacatttttaagatttttgttatgttctgaattcccccctacacacacacacacacacacacacacacacacgtgcaaaaaatatgatcaagaatgcaattgggatttgtgagcaatgagtagacctcttattgtttatatttgtaccctcattgtcaatttttttttagggaatttgggactctgcctatataaggtgttttaaatgtcttgagaacaagcactggctgatacctcttggagatatgatctgaaatgtaatggaatttattaaatggtgtttagtaaagtaggggttaaggacttgttaaagaaccccactatctctgagaccctatagccaaagcatgaggacttggagagctactaaaatgattcaggtttacaaaatgagccctgtgaggaaaggttgagagaagtctgaggagtttgtatttaattatagtcttccagtactgtatattcattcattactcattctacaaatatttattgaccccttttgatgtgcaaggcactatcgtgcgtcccctgagagttgcaagtatgaagcagtcatggatcatgaaccaaaggaacttatatgtagaggaaggataaatcacaaatagtgaatactgttagatacagatgatatattttaaaagttcaaaggaagaaaagaatgtgttaaacactgcatgagaggaggaataagtggcatagagctaggctttagaaaagaaaaatattccgataccatatgattggtgaggtaagtgttattctgagatgagaattagcagaaatagatatatcaatcggagtgattagagtgcagggtttctggaaagcaaggtttggacagagtggtcatcaaaggccagccctgtgacttacactgcattaaattaatttcttagaacatagtccctgatcattatcactttactattccaaaggtgagagaacagattcagatagagtgccagcattgtttcccagtattcctttacaaatcttgggttcattccaggtaaactgaactactgcattgtttctatcttaaaatactttttagatatcctagatgcatctttcaacttctaacattctgtagtttaggagttctcaaccttggcattattgacatgttaggccaaataattttttttgtgggaggtctcttgtgcgttttagatgattagcaataatccctgacctgttatctactaaagactagtcgtttctcatcagttgtgacaacaaaaatggttccagatattgccaaatgccctttagaggacagtaatcgcccccagttgagaaccatttcagtaaaactttaattactattttttcttttggtttataaaataatgatcctgaattaaattgatggaaccttgaagtcgataaaatatatttcttgctttaaagtcccca

SEQ ID NO: 1977 - DNA, 2357 bp, Homo sapiens
aagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcaggtttctctaacaaaacaccagactcacctccccggcacctgccccccagatcctgtcatctgataacgcagcattggaacatagagtgtagagaagaactctcatgcacctcctcccatgtaaactgtggctacagggaaaagtcactgtgatttgtgtttactaagaccctgtaggtgtttagatgccttagatttcataatgaaggcagaaggaaagaagcctatcaggcaagtgttaggtgagccagaagcaggacgtggtttatccctgtaaatgtcaatgaacgtaaccagtcttgtgcgcacacacacccagcagcaagaggccagggtctccgagacaaagaacatagactgaatgatagttgtcttcttcattctgtcctagagcaacttctgcacctgaaaagcag

SEQ ID NO: 1978 - DNA, 6069 bp, Homo sapiens
aagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttctttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgataa

SEQ ID NO: 1979 - DNA, 3446 bp, Homo sapiens
aagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactggaaagatcatacggtggtgaaacttcgacaagatcacagcccatcacgttcaggccttgacaacccctgatgatctccagagcctattcaagatcaagactgagttgtccacagtggtaatcatttacagtgaaaagcacccagtagagcttttcccagcccacgccaccctttgacttggaattggctttccctccataaacatttgttgactgccaggcacactggcaggcctcccagagaaacagataatgcgtacacagtccctgctcctcagggctgcatggtgtggtgatggagacaaggaaaccaatcgtttcaatgtcatgcaccaagggcttcaaggaaagcaagcccagaatggtatcagcataggtaatagcctggagaggtgggtaaggcttccccaaggtggaaatacccagttcaagggataggccaggcagagggaaaaacacaggcaaaggcaccaagatgggaaaagttcaggtagtaagatgtggccagaagacagagtaagtgagggagactgatgggaagagagtgaccttgtctgaaagggttcccatcctgcaggtgaaaagcccagaaggttgctaagcagagggatgaggaatgtgtttcagaaatccctcatgagaagagaggatggttacagccatttcaagagagagagttatggccaccctcctttaagatcttagaggatgtaaggtacttgattaggtttaagcagtcttcattcatttactctcaaatgtctttgagtgcctactatttgtattaggcactgtcctaggctccaaggacaaggtagggaacaatacataggtcctgcccttggggagattctagtcataaccattctgcccccgtgcatttactcccagcacacattattggagctttatttgggtgtttctaaaactcttgagcttaccttggcaggtaattgtgccatcacatgcacttttatttatttatttatttatttatttatttatttatttatttttgagacagggtctctgtcacccgggctatagtgcagtggtatgatcacggctcactgaaggcttgacctgccaggctcagttgatcctcctgccccagcctccctagtagctgggactacaggtgcacactagcacaccagactaatttttatttttatttttagtaaagatgggatctcactatgttgcccaggctgggctgaaactcctgggctcaaacgatccatccaccctggcctcccaaagtgctgaggatagtgcctgagccaccgcgcctggcccgttgtatgcacttttatttaaatttaaccctaaaaa

SEQ ID NO: 1980 - DNA, 2832 bp, Homo sapiens
ccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcaggtttctctaacaaaacaccagactcacctccccggcacctgccccccagatcctgtcatctgataacgcagcattggaacatagagtgtagagaagaactctcatgcacctcctcccatgtaaactgtggctacagggaaaagtcactgtgatttgtgtttactaagaccctgtaggtgtttagatgccttagatttcataatgaaggcagaaggaaagaagcctatcaggcaagtgttaggtgagccagaagcaggacgtggtttatccctgtaaatgtcaatgaacgtaaccagtcttgtgcgcacacacacccagcagcaagaggccagggtctccgagacaaagaacatagactgaatgatagttgtcttcttcattctgtcctagagcaacttctgcacctgaaaagcagcatcaagccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttcc

SEQ ID NO: 1981 - DNA, 5103 bp, Homo sapiens
cgtgccccgcgctccgcgcccccttctctttcagcctcgggcacgggggaggctcggcggacctgctgattgggaaccgatatggcggcgactctgggcagcggggagcgctggacggaagcttacattgacgcagttagaagaaacaaatacccagaagacacacctcctgagagtcatgacccctgtggctgctgtaactgcatgaaggcacaaaaggaaaagaagtctgagaatgagtggactcagacccggcagggtgaggggaactccacgtatagtgaggaacagctgcttggggtacaaaggatcaagaaatgcagaaattactatgaaattctgggagtttctcgagatgctagtgacgaagagcttaagaaagcttacagaaaactcgccctgaaatttcaccctgacaagaactgtgctcctggagcaacagatgctttcaaagcaataggaaatgcatttgcagtcctgagcaatcctgataagagacttcgctatgatgaatacggagatgaacaggtgactttcactgcccctcgagccagaccttataattattacagggattttgaagctgacatcactccagaagagctgttcaacgtcttctttggaggacattttcctacaggaaatattcatatgttttcaaatgtgacagatgacacttactattaccgtcgacggcaccgacatgagaggacacagactcagaaggaggaggaagaagagaaacctcagactacatattctgcatttattcagctacttccagttcttgtgattgtgattatatctgtcattactcagctgctggctactaatcccccatatagtctgttctataaatcgaccttgggctacaccatttctagagaaactcagaacctgcaggtgccttactttgtggataaaaactttgacaaggcctacagaggagcttctctgcatgacttggagaaaacaatagagaaggattacattgattatatccagactagttgttggaaggagaaacaacaaaagtcagagctgacaaatttggcaggattatacagagatgaacgattgaaacagaaagcagagtcgctgaaacttgaaaactgtgagaaactttccaaactcattggcctacgcagaggtggctgagaggataatggtcctacgcagggctggggttttgctacttgttcctatttatgttcctgattccattttataatacaaaactaggtaatgatgaacactttactatttgctaacttcgttggttgggcagagtggcaggagcatgggcacgagagccagatgtgtcttcacaggatccttcctggggagtggctccagggaccaggagtagttcatctaagttaaattaatggcaaggcattggattccgtctccctgctccatgcctaccctgcctatgtgaatggagttcagggcatcccagagcagatccatgctttcttccttcttcccttcttcagtgaagtcttaagaaccaggcattcctaggcttagccaaagcttaatattagttatttacactgtctaccaagaattatacctctcccttcattagagtcatcatctccgccaagatttagcctttggaacatgttcctgcccagctttccattttctaggggaatatggagaaatttaaactattgtagtcaatagttttctattattccaatctctgctcagttagtagcattagcaaactgcctaatttgagattcctttatttccttaaccctctctcctttagagagtccagaaattaaaactactgagcagcatctggaggcgggggccagggcgaaggtataatgcaagaccgagcctcatctcctccacgaagcctccctactccatcatagaacccagagaatgtcccttcggtcatttcccctcagtatcatcattggtgtcatcgcacttaggctgagttcctacatcccacagaggcagatggtcagacccaggaggaggcattgccagctctccaggctgtttgctcaagcctagagatagaggagacagatcctctctccttggatatgggggtctagctttggccccagcagccactttgtttaacccagtatcctatagtttgtgatttgagatgatttttcattcattcaacatttattgagtgcctactataaaagcaggggctctcacacatattttcttacttaaacctcctcacaactctgaagtagatgtattatccctggttctatgaatgagaacattggcccagagaggatgacccaggtcttgtagtggcagagcaagacggtaggctgagtgtcaagtagaaagtgggagagcatcctcatgtctcaggtgattctagccagactggcaaagcagaacctttcccgaggatgcctccgtcctccccaaccccatgacccctcatcttttctgtggcaatcttgcatctgttcaggacaacatccctgctgctctttaggaagcaggaccctgtctaacataaattctgtacacaaaataagaggtccctcacaggcaggcagccctccactggtgactaggaagaattcagtcactgcctgggctgtgtggttctgggccttcctgtggagctgagctgcctgaattatcatgactctgaacttggaaggatcattaagtgactgtagcctacactccatgcttccttcatattggaagaaaagtttctggtagagagtcggccgggtgcactggctcaagcctgtaatcccagcactttgggaggctgtggcaggtggatcacctgaggtcaggagttcaagaccagcctggccaacacagtgaaaccccatctctactaataatacaaaaattagccaggtgtggtggcacatgcctgtagtcccagctactcgggaggctgaggcatgagaatcgctgcaacttgcaaggtggaggttacagtgagctgaaatcacgccactgcactccactccatctcaaaaaaaaaaagagtctacattaaacagattccaaagtaaagtttcttcatcccaatgcatggccatgatttacacagacgtgcctagcatggctcatcaacatctgaacggttgttccctaccatgcctctgcaggcattccacagagtcaggagatgggttcacaggtaaagattgggggctttagtggcttgtaggggacaactgctcagttgcagggagagggagcatttctagaaatagccagattttgctgcccaactagatctgtcctcctggttttagggggcccttcttgatcccctctgagtgactgagggaggttacattgtaaaatatgtccatgagccaaacaggcttatggaaagttcttctacacacaaaaaaatcaaagctctcctctccccatccccaaccactgctagaaaattggccataatgaaactgacttgacaggttaaaagaccctgtcctagatgcccaggaatcaggtagtcacacattttatggacttcatggcagcgataagtaatctgtgatgatactaaatagaagcaataataactaactccattaaatgtcacgctgattgtctgtttttatagcaccgatggtactgttttatttattgccaatagaccacaacattcacatctgtttttcctcaagggaaccgtatttgcttttggttgaaggatttatctatttgatactatccagaatattgtgaagctataatttcctgggttatattttagatgggttgtctgcatggtggtaaaataagctttttcctctcgcctacgtcctttggaagatctcctgatcatacataactaggtagggcttattcttgctgccggagcttggcacccagctctagactgtttctttgagcattactgcagattggagacgtgtgtgagaggagcagcgctcagaaatagggcttgaggctcaagcagaaactgaagctctcattcaaatgaagatgctctctctaccgcacgatcggcagtgagaaaaggaggatgaaaatccttctcatcacaaagagcttgaaggaacccacgtccccagattagcaaccctagagttcatctgctcaggccgggaaatgtgtaagcttccttgatcagctccaggcctcacagcacgggagcagtgaccagtaaggaaacgtcactgctgtgctttctgttggaaattgttcgaaaatacagtgaactggccaggcccagtagctcatgcctgtaatcccagcactttgaaaggctgaggcaggcagatcatttgaggtcaggagttccagaccagcctggccaacatggtgaaaccctgtctgtactaaaaatacaaaaattaggcgggcatggtagcacgtgtctgtaatcccagctcctcaggaggctgaggcagaagaatctcttgagcctgggaggcagaggttgcagtaagctgagatcacatcattgcactccagcctgggtgacagagcaagactctgtctcaaaaaaaaaaaaagaaagaaaaaagaaaatacagtgaactccagatgccactggaacatgggttccagcagcctggccaagctatgtgtcattctttttcctcatgatacccaggatgggctttgtgaggaggcactgtgccgttccagtggctttctgttacagctggccacaccatacaagcaagtacatcatctgcatgcactgctcctcacaggagcttgcacttcattcatatttattctgccctcatttaaggtataagcttagtgtcctaatatatttatttttggaaagggccaagttacaaaacatcttttttttgaggctgcactgttgatatgtcatgcagtggccaccaagaaagtatatactcgtgttagatactgattacatcatttacatcacgctcagtatttggaattaaagatgtgaatgttctgtgaccagagtagggatgacacaaatggaatcagctcctggtggactaagaatcttgaaaaaatctggccacctcatccactacatctggattgagtgtactgcaacaaagaaaaacattaaacaattttatattaaaagaa

SEQ ID NO: 1982 - DNA, 579 bp, Homo sapiens
gttattctgcctgccatgggcactgagtacagctgctcatcatactggactaatcaggtcaaggacatggggcttcattctaagtaactcagctgtcatcttcattataaaaccacacattttcctctgactctgggcaatgacctgcgtatataagctgttagtcataagggctggatggggcagcatctcaatcatatagggcacaggacagacctcagtatcaccagcaagaatccattacagttcaacatgtaagtagtacctccagaccttttccctgtgcccctggactccaaggtctatcccaccctcagctgtccatcttctagagcaggcggtctagcctccccaaaccagaagaacttcctttttatattcaaccacctgatggatgtccctgatcagttccctcagctgcagagcacaagaaggaccttcaggatccagctttctcctcgggcacgggggaggctcggcggacctgctgattgggaaccgatatggcggcgactctgggcagcggggagcgctggacggaagcttacattgacgcagttagaagaaacaaatacccag

SEQ ID NO: 1983 - DNA, 832 bp, Homo sapiens
gtttgtgctgttgttattctgcctgccatgggcactgagtacagctgctcatcatactggactaatcaggtcaaggacatggggcttcattctaagtaactcagctgtcatcttcattataaaaccacacattttcctctgactctgggcaatgacctgcgtatataagctgttagtcataagggctggatggggcagcatctcaatcatatagggcacaggacagacctcagtatcaccagcaagaatccattacagttcaacatcctcgggcacgggggaggctcggcggacctgctgattgggaaccgatatggcggcgactctgggcagcggggagcgctggacggaagcttacattgacgcagttagaagaaacaaatacccagaagacacacctcctgagagtcatgacccctgtggctgctgtaactgcatgaaggcacaaaaggaaaagaagtctgagaatgagtggactcagacccggcagggtgaggggaactccacgtatagtgaggaacagctgcttggggtacaaaggatcaagaaatgcagaaattactatgaaattctgggagtttctcgagatgctagtgacgaagagcttaagaaagcttacagaaaactcgccctgaaatttcaccctgacaagaactgtgctcctggagcaacagatgctttcaaagcaataggaaatgcatttgcagtcctgagcaatcctgataagagacttcgctatgatgaatacggagatgaacaggtgactttcactgcccctcgagccagaccttataattattacagggattttgaagctgacatcactccagaa

SEQ ID NO: 1984 - DNA, 1046 bp, Homo sapiens
gttgttattctgcctgccatgggcactgagtacagctgctcatcatactggactaatcaggtcaaggacatggggcttcattctaagtaactcagctgtcatcttcattataaaaccacacattttcctctgactctgggcaatgacctgcgtatataagctgttagtcataagggctggatggggcagcatctcaatcatatagggcacaggacagacctcagtatcaccagcaagaatccattacagttcaacatgtagtacctccagaccttttccctgtgcccctggactccaaggtctatcccaccctcagctgtccatcttctagagcaggcggtctagcctccccaaaccagaagaacttcctttttatattcaaccacctgatggatgtccctgatcagttccctcagctgcagagcacaagaaggaccttcaggatccagctttctcctcgggcacgggggaggctcggcggacctgctgattgggaaccgatatggcggcgactctgggcagcggggagcgctggacggaagcttacattgacgcagttagaagaaacaaatacccagaagacacacctcctgagagtcatgacccctgtggctgctgtaactgcatgaaggcacaaaaggaaaagaagtctgagaatgagtggactcagacccggcagggtgaggggaactccacgtatagtgaggaacagctgcttggggtacaaaggatcaagaaatgcagaaattactatgaaattctgggagtttctcgagatgctagtgacgaagagcttaagaaagcttacagaaaactcgccctgaaatttcaccctgacaagaactgtgctcctggagcaacagatgctttcaaagcaataggaaatgcatttgcagtcctgagcaatcctgataagagacttcgctatgatgaatacggagatgaacaggtgactttcactgcccctcgagccagaccttataattattacagggattttgaagctgacatcactccagaagagctgttcaacgtcttctttggag

SEQ ID NO: 1985 - DNA, 2069 bp, Homo sapiens
gggggacctcggagatccacgagattgccagagaaggaaattgaggcccaagaagctgcatgacttagccaagttcacggagtagaacccgggattggagcccgggacattgaaatgaaggcgtcttgcattgcagctccgttgcagcgcagaggcgcaggaaggcagactaccacgagcctcgggctgcggcctcgccctcctggtcgagcctcctgccctccaaccctctgctcccgtttctccctctggttcatagcccgcgggacagagcagccctggattgggaggctcctcaggtctcaggctcaggtgcagaagcagagcccctaactggaaggctcggaggtgggccggtgaggcaagcaagccctgtggggggttgaggacagcttgggttggatgtccctcactgcagcctgtccgtggatgtctctgccttaagggaattggaggtggaaccatccagtcttgaaggtcaacggagcgtgaagagaggagcgtgcagcttgagggtctaaggataactctggggccatgacagccatgagtctcacagaggaccccgagacttctgtgctgcgagtaaccggacttgttctgagacctttgccctagaggatggccaaggggctcctggtgacctatgccctctgggctgtggggggccctgctgggctccaccacctgtacctgggaagggacagccacgccctgctctggatgctgaccctggggggaggtgggctgggctggctctgggagttctggaagctcccaagctttgtagctcaggccaacagagcccagggacagaggcagagccccagaggggtgacaccccctctgagtcccattcgctttgctgcccaggtgatagttggcatctattttggccttgtggcactgattagcctttcttccatggtcaacttctatattgtggccctcccactggcagttggcttaggggtcttgctggtggctgctgttggcaaccagacctcagactttaagaacactctggggtcagcatttctcacttcacctatcttctatggccgccccatagccatactgcccattagcgtggccgccagcattacagctcagaggcatcgccgctacaaagctttggtggcatcagagccgctcagtgtgcggctctatcgtctgggcttggcttaccttgctttcacaggcccactggcatacagtgccctctgcaacacagctgccaccctcagctatgtggcagaaacctttggctccttcttgaattggttcagcttcttcccccttcttggccgcctcatggagtttgtcctccttctgccttaccggatctggaggctactgatgggggagactggcttcaacagcagctgctttcaggagtgggcgaagctctatgagtttgttcacagttttcaggatgagaagcgtcagctggcttaccaggttttgggcctctcagaaggggcaacaaatgaagaaatacatcggagttaccaggagctagtgaaggtctggcacccagaccacaacctggaccagacagaggaggcacagaggcacttcctggagatccaggctgcgtatgaagtcctgagtcaacccaggaagccctggggatcccggaggtgaaaagaaacttccccctgaggactgactcttcctagcagagctgggcaacttgtcccaaatctagctttgcccacgaatggcatcccaacagagttaaagaaactgcttgcaggggctgggcgtggtggctcatgcctgtaatcccagcactttgggaggccgaggcgggcagatcacgaggtcaggagttcgagaccagcagcctggccaatatagtgaaacttcgtctctactaaaaatacaaaaaattagccaggagtggtggcaggcacctgtagtcccagctacttgggaggctgaggcaggagaatcacctgaacctgagaggcggaggttgcagtgagccgagatcacgccactgcactccagcctgggcaacaagagtgaaactccgtctcaaaaaaaaaaaaaagaaagaaaaa

SEQ ID NO: 1986 - DNA, 2628 bp, Homo sapiens
agcatttcctctccaggccgagatgagggctgagggcgtttggagggaagcgctctgcctactgccgggaggtgacacccgcgaggccgaccgtcccccgaagcccccgcaagtccagactgggggacctcggagatccacgagattgccagagaaggaaattgaggcccaagaagctgcatgacttagccaagttcacggagtagaacccgggattggagcccgggacattgaaatgaaggcgtcttgcattgcagctccgttgcagcgcagaggcgcaggaaggcagactaccacgagcctcgggctgcggcctcgccctcctggtcgagcctcctgccctccaaccctctgctcccgtttctccctctggttcatagcccgcgggacagagcagccctggattgggaggctcctcaggtctcaggctcaggtgcagaagcagagcccctaactggaaggctcggaggtgggccggtgaggcaagcaagccctgtggggggttgaggacagcttgggttggatgtccctcactgcagcctgtccgtggatgtctctgccttaagggaattggaggtggaaccatccagtcttgaaggtcaacggagcgtgaagagaggagcgtgcagcttgagcactacagataggagcgtcccttgctcctgccaggcagcccctccataggggcagtcctgtgctgctgtgcctcggtacccgcacaaggtgtctggggaccgcccggacccccccttccatcggcggcagcgccacctggcggccatggtgcggtggtgtgggaggagctgggcccgggctgggcactgagcccaccggagctgcaggcgtctgcagagccttgcaccgagtttccccgcgagggcgggcgggaggagtcccaggcgggaatgtgatccccagggggccggggagggccctggggaggagcctggcctggggaagccggacttccgtgacacaacagacacaaaagacaaagtccatttggatggaagtgggagcagggcgagacgggccattttcactctgtggtcaaaggaaatgactggtctgactcggtctgggagcggggcacccagggtctaaggataactctggggccatgacagccatgagtctcacagaggaccccgagacttctgtgctgcgagtaaccggacttgttctgagacctttgccctagaggatggccaaggggctcctggtgacctatgccctctgggctgtggggggccctgctgggctccaccacctgtacctgggaagggacagccacgccctgctctggatgctgaccctggggggaggtgggctgggctggctctgggagttctggaagctcccaagctttgtagctcaggccaacagagcccagggacagaggcagagccccagaggggtgacaccccctctgagtcccattcgctttgctgcccaggtgatagttggcatctattttggccttgtggcactgattagcctttcttccatggtcaacttctatattgtggccctcccactggcagttggcttaggggtcttgctggtggctgctgttggcaaccagacctcagactttaagaacactctggggtcagcatttctcacttcacctatcttctatggccgccccatagccatactgcccattagcgtggccgccagcattacagctcagaggcatcgccgctacaaagctttggtggcatcagagccgctcagtgtgcggctctatcgtctgggcttggcttaccttgctttcacaggcccactggcatacagtgccctctgcaacacagctgccaccctcagctatgtggcagaaacctttggctccttcttgaattggttcagcttcttcccccttcttggccgcctcatggagtttgtcctccttctgccttaccggatctggaggctactgatgggggagactggcttcaacagcagctgctttcaggagtgggcgaagctctatgagtttgttcacagttttcaggatgagaagcgtcagctggcttaccaggttttgggcctctcagaaggggcaacaaatgaagaaatacatcggagttaccaggagctagtgaaggtctggcacccagaccacaacctggaccagacagaggaggcacagaggcacttcctggagatccaggctgcgtatgaagtcctgagtcaacccaggaagccctggggatcccggaggtgaaaagaaacttccccctgaggactgactcttcctagcagagctgggcaacttgtcccaaatctagctttgcccacgaatggcatcccaacagagttaaagaaactgcttgcaggggctgggcgtggtggctcatgcctgtaatcccagcactttgggaggccgaggcgggcagatcacgaggtcaggagttcgagaccagcagcctggccaatatagtgaaacttcgtctctactaaaaatacaaaaaattagccaggagtggtggcaggcacctgtagtcccagctacttgggaggctgaggcaggagaatcacctgaacctgagaggcggaggttgcagtgagccgagatcacgccactgcactccagcctgggcaacaagagtgaaactccgtctc

SEQ ID NO: 1987 - DNA, 1183 bp, Homo sapiens
ctcttgcaccgcctgccgaatcaattcaacatggcagccatgcgctggcgatggtggcagcggctgttaccttggaggttgctgcaggcccgtggctttccacaaaattctgcacccagcctgggcctaggagcgaggacttattcccagggcgactgctcgtattcgcgcacggcgctgtatgatctgctcggcgtcccctccacagccacgcaggcccaaatcaaggcggcttactaccgtcagtgctttctctaccacccggaccgcaactccgggagcgcggaggccgccgagcgcttcacgcgcatctcccaggcctacgtggtgctgggcagtgccaccctccgtcgcaagtatgatcgcggcctactcagcgacgaggacctgcgcggacctggcgtccggccctccaggacgcccgcacccgaccccggctcgccgcgtaccccgccgcccacctctcggacccacgacggttctcgggcctcccccggcgccaaccgcacgatgttcaactttgacgccttctaccaggcccactacggggaacaactggagcgggaacggcgcctgagggcccggcgggaggcccttcgcaaacggcaggagtatcggtccatgaaaggcctccgctgggaggatacccgagacacggctgccattttcctcatcttttcaatcttcatcatcatcggcttttatatttaatcggagagagaagggaaggggagtgtccccagccaaccccccagaaacggccttttttcctgcctctgaacccttggccattgatagtctacctttgctgggatccgaaggaactgtactccccctgccctccccgacccgcccagcttagccgatgacctgcacatcgctccactgtggtccagaaaaggaggcctttcgatgtctgagaaagaggccccacgctgtagagtcccgaaagcccaggagtgaagggggttcctggagtctctagggtgcttcttccagagtctgtcttcttgcttccagatgtggtcaacttctggaacactcgctgtagctttattgtttagccccaagcaagatttatctcctcctgccccgcatgtgtatggtgggcctctgtaaccttgaaatgtgcaatgtgaccaattgttgactaccaaaagaaaaggtctggggttgtacgaaa

SEQ ID NO: 1988 - DNA, 522 bp, Homo sapiens
atgcgctggcgatggtggcagcggctgttaccttggaggttgctgcaggcccgtggctttccacaaaattctgcacccagcctgggcctaggagcgaggacttattcccagggcgactgctcgtattcgcgcacggcgctgtatgatctgctcggcgtcccctccacagccacgcaggcccaaatcaaggcggcttactaccgtcagtgctttctctaccacccggaccgcaactccgggagcgcggaggccgccgagcgcttcacgcgcatctcccaggcctacgtggtgctgggcagtgccaccctccgtcgcaagtatgatcgcggcctactcagcgacgaggacctgcgcggacctggcgtccggccctccaggacgcccgcacccgaccccggctcgccgcgtaccccgccgcccacctctcggtccatgaaaggcctccgctgggaggatacccgagacacggctgccattttcctcatcttttcaatcttcatcatcatcggcttttatatttaa

SEQ ID NO: 1989 - DNA, 1288 bp, Homo sapiens
acaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 1990 - DNA, 724 bp, Homo sapiens
gcttccgcccggcgcccacttccaagatggcggcggggcggggccggggcagggcggacggagccggcgagcgggatgctgcggactgcgctgcgcggcgcgccgaggttgctgagtcgcgtgcagccccgggcgccctgcctgaggcggctgtggggccgcggggcccgtccagaggtcgcggggaggcggcgggcctgggcctggggctggcggcgctcaagctccgagcaggggccggggcccgcggcggctctggggcgcgtggaggcggcgcactaccagctcgtctacacctgcaaggtctgcgggactaggtcctccaagcgcatctccaagctggcctatcaccaaggcgtggtcattgtgacctgccccggctgccagaaccaccatatcatcgctgacaacctgggctggttctcggacctgaatgggaagagaaatatcgaagagatcctgacggccagaggcgagcaggtgcaccgtgtggcgggcgagggggccctggaactggttctggaggctgcaggggcccccacatccactgcagctccggaagcgggtgaggatgagggtccccccagccctggcaagacggagccgagctgactcctgcgctccccggcactgtgggacttcggccttccagaaggaggttttggccctgggcctctctggacgtggcctgttttctatcaataaacagacattacttccagat

SEQ ID NO: 1991 - DNA, 2090 bp, Homo sapiens
gttgccgcggggcggtgccaagatggcgaggcccaaagaggtgaggagccggcagcgggggcggctgtaactgtgaggaaggctgcagagtggcgacgtctacgccgtaggttggaggctgtggggggtggccgggcgccagctcccaggccgcagaagtgacctgcggtggagttccctcctcgctgctggagaacggagggagaaggttgctggccgggtgaaagtgcctccctctgcttgacggggctgaggggcccgaagtctagggcgtccgtagtcgccccggcctccgtgaagccccaggtctagagatatgacccgagagtgcccatctccggccccggggcctggggctccgctgagtggatcggtgctggcagaggcggcagtagtgtttgcagtggtgctgagcatccacgcaaccgtatgggaccgatactcgtggtgcgccgtggccctcgcagtgcaggccttctacgtccaatacaagtgggaccggctgctacagcagggaagcgccgtcttccagttccgaatgtccgcaaacagtggcctattgcccgcctccatggtcatgcctttgcttggactagtcatgaaggagcggtgccagactgctgggaacccgttctttgagcgttttggcattgtggtggcagccactggcatggcagtggccctcttctcatcagtgttggcgctcggcatcactcgcccagtgccaaccaacacttgtgtcatcttgggcttggctggaggtgttatcatttatatcatgaagcactcgttgagcgtgggggaggtgatcgaagtcctggaagtccttctgatcttcgtttatctcaacatgatcctgctgtacctgctgccccgctgcttcacccctggtgaggcactgctggtattgggtggcattagctttgtcctcaaccagctcatcaagcgctctctgacactggtggaaagtcagggggacccagtggacttcttcctgctggtggtggtagtagggatggtactcatgggcattttcttcagcactctgtttgtcttcatggactcaggcacctgggcctcctccatcttcttccacctcatgacctgtgtgctgagccttggtgtggtcctaccctggctgcaccggctcatccgcaggaatcccctgctctggcttcttcagtttctcttccagacagacacccgcatctacctcctagcctattggtctctgctggccaccttggcctgcctggtggtgctgtaccagaatgccaagcggtcatcttccgagtccaagaagcaccaggcccccaccatcgcccgaaagtatttccacctcattgtggtagccacctacatcccaggtatcatctttgaccggccactgctctatgtagccgccactgtatgcctggcggtcttcatcttcctggagtatgtgcgctacttccgcatcaagcctttgggtcacactctacggagcttcctgtccctttttctggatgaacgagacagtggaccactcattctgacacacatctacctgctcctgggcatgtctcttcccatctggctgatccccagaccctgcacacagaagggtagcctgggaggagccagggccctcgtcccctatgccggtgtcctggctgtgggtgtgggtgatactgtggcctccatcttcggtagcaccatgggggagatccgctggcctggaaccaaaaagacttttgaggggaccatgacatctatatttgcgcagatcatttctgtagctctgatcttaatctttgacagtggagtggacctaaactacagttatgcttggattttggggtccatcagcactgtgtccctcctggaagcatacactacacagatagacaatctccttctgcctctctacctcctgatattgctgatggcctagctgttacagtgcagcagcagtgacggaggaaacagacatggggagggtgaacagtccccacagcagacagctacttgggcatgaagagccaaggtgtgaaaagcagatttgatttttcagttgattcagatttaaaataaaaagcaaagctctccta

SEQ ID NO: 1992 - DNA, 1538 bp, Homo sapiens
aaagaggtgaggagccggcagcgggggcggctgtaactgtgaggaaggctgcagagtggcgacgtctacgccgtaggttggaggctgtggggggtggccgggcgccagctcccaggccgcagaagtgacctgcggtggagttccctcctcgctgctggagaacggagggagaaggttgctggccgggtgaaagtgcctccctctgcttgacggggctgaggggcccgaagtctagggcgtccgtagtcgccccggcctccgtgaagccccaggtctagagatatgacccgagagtgcccatctccggccccggggcctggggctccgctgagtggatcggtgctggcagaggcggcagtagtgtttgcagtggtgctgagcatccacgcaaccgtatgggaccgatactcgtggtgcgccgtggccctcgcagtgcaggccttctacgtccaatacaagtgggaccggctgctacagcagggaagcgccgtcttccagttccgaatgtccgcaaacagtggcctattgcccgcctccatggtcatgcctttgcttggactagtcatgaaggagcggtgccagactgctgggaacccgttctttgagcgttttggcattgtggtggcagccactggcatggcagtggccctcttctcatcagtgttggcgctcggcatcactcgcccagtgccaaccaacacttgtgtcatcttgggcttggctggaggtgttatcatttatatcatgaagcactcgttgagcgtgggggaggtgatcgaagtcctggaagtccttctgatcttcgtttatctcaacatgatcctgctgtacctgctgccccgctgcttcacccctggtgaggcactgctggtattgggtggcattagctttgtcctcaaccagctcatcaagcgctctctgacactggtggaaagtcagggggacccagtggacttcttcctgctggtggtggtagtagggatggtactcatgggcattttcttcagcactctgtttgtcttcatggactcaggcaccaggcccccaccatcgcccgaaagtatttccacctcattgtggtagccacctacatcccaggtatcatctttgaccggccactgctctatgtagccgccactgtatgcctggcggtcttcatcttcctggagtatgtgcgctacttccgcatcaagcctttgggtcacactctacggagcttcctgtccctttttctggatgaacgagacagtggaccactcattctgacacacatctacctgctcctgggcatgtctcttcccatctggctgatccccagaccctgcacacagaagggtagcctgggaggagccagggccctcgtcccctatgccggtgtcctggctgtgggtgtgggtgatactgtggcctccatcttcggtagcaccatgggggagatccgctggcctggaaccaaaaagacttttgaggggaccatgacatctatatttgcgcagatcatttctgtagctctgatcttaatctttgacagtggagtg

SEQ ID NO: 1993 - DNA, 2177 bp, Homo sapiens
ggctgctcgaagaagcccggtctccgggtaagatggcagcggacggacagtgctcgctccccgcttcatggcggccggtgaccctcacccacgtcgaatatcctgcaggtgatctctctggccacctccttgcctacctgagcctcagccctgtatttgtcatcgtcggtttcgtgaccctcatcatatttaagcgggagctgcacacgatctccttccttgggggcctggcactgaacgagggggtcaactggctgatcaaaaacgtcatccaggagccacggccctgtggaggcccccacacagcagtgggcaccaagtacgggatgccctccagccattcccagtttatgtggttcttctccgtctattccttccttttcctgtatttaagaatgcaccaaacaaacaacgccaggttcctggacttgctgtggaggcacgtgctctccctgggactcctcgctgtggccttcctagtctcctacagcagggtctacctgctgtaccacacctggagccaggtgctctatggaggcatcgctggaggcctcatggccatcgcctggttcatcttcacccaggaggtcctcaccccgctgttccccaggatagcagcctggcctgtctccgagttcttcctaatccgagacacaagcctcattcccaacgtactctggtttgagtacacggtaacccgggcagaagccaggaacagacaacgcaagctggggacgaaactgcagtgaccagtgggtgtggctgggtccagcctccagatctggcccgcacgatgccttgcaggatggacaggatgacagacagggacgaagcagagacctctacagacccaagtcaccaagtggagcctttttttttcttattttaattttaatgaacaaggtggaccaaagggctgaaccagcccctcaaccaggaccctggggggcctgctgcctgggggccgtggccagagaccctcgctgtgctgctgccagcccctggctgggcagaaagtgccctcggcatgggcacctgggtgtggggtggaggaggagggctcgcgcctctggtctcggggccaggaattccaggtggcgtgagaagtacacactatttattttttggttttgtcagaggcaggcaggattttggagctggaagaatctgctctccggtggctgccctgtgaacagagggctcccggtcagcttcccaggcccttcgccctatgcccagagggcagactgcctctccctgggccggggtggcctgggtgccaggaggaggggagcataccccacaccctccctgccaccgttgccgttccagaacctcggtcagtgtttccctgtctgggggcagggcccagagcgagcacgcgtctggcggctgctgtcgttgtgttctaccccgtactgacccaacaccacaagggctttctctggtcccctgtccctaagacaataatcgctttctgacaaaggagcctgcacatttgggtgagcagacccaagctgtttacagctctttcttgtcctgccatccagtagcagttagtcttcatccccacgtgaacaaaatgggaaggagccgtgaggagaggagtgaggcaacaggcacccgaagtccctcgtccttccctctgtgtgctctgaatatgtccttgtccttcctgacccatctctgaccagctgggaacctgcttggggtccccctcaaacctgtgtctggggtgtgggctcacagatccctatcagcctggttcgtgggagggctcttcctaaagggacccccatctctaagtcactctgaaagggagttgtggagaggagacgcctccagactctcagaagttttgaggactgaactgggtcactcgggatctgtgttcgaatcctccccacccctttctttgtggagtttcctaacctgctgctgaagcacaatgttttggtgctttcttttctcatttgttaaaggcagtgtccaaaagccattccagatgccaagaccaggggcttatttctagggaaggtaggtcggtttccatgtttccctcccgttatttttattttttactttttgcctgagacaagccgagtatgaggtggtttgatttaagaaaaatcaatgaaattgtttactactgttttaaaataaaaccgtaaactctg

SEQ ID NO: 1994 - DNA, 2037 bp, Homo sapiens
gaagcccggtctccgggtaagatggcagcggacggacagtgctcgctccccgcttcatggcggccggtgaccctcacccacgtcgaatatcctgcaggtgatctctctggccacctccttgcctacctgagcctcagccctgtatttgtcatcgtcggtttcgtgaccctcatcatatttaagcgggagctgcacacgatctccttccttgggggcctggcactgaacgagggggtcaactggctgatcaaaaacgtcatccaggagccacggccctgtggaggcccccacacagcagtgggcaccaagtacgggatgccctccagccattcccagtttatgtggttcttctccgtctattccttccttttcctgtatttaagaatgcaccaaacaaacaacgccaggttcctggacttgctgtggaggcacgtgctctccctgggactcctcgctgtggccttcctagtctcctacagcaggcctgtctccgagttcttcctaatccgagacacaagcctcattcccaacgtactctggtttgagtacacggtaacccgggcagaagccaggaacagacaacgcaagctggggacgaaactgcagtgaccagtgggtgtggctgggtccagcctccagatctggcccgcacgatgccttgcaggatggacaggatgacagacagggacgaagcagagacctctacagacccaagtcaccaagtggagcctttttttttcttattttaattttaatgaacaaggtggaccaaagggctgaaccagcccctcaaccaggaccctggggggcctgctgcctgggggccgtggccagagaccctcgctgtgctgctgccagcccctggctgggcagaaagtgccctcggcatgggcacctgggtgtggggtggaggaggagggctcgcgcctctggtctcggggccaggaattccaggtggcgtgagaagtacacactatttattttttggttttgtcagaggcaggcaggattttggagctggaagaatctgctctccggtggctgccctgtgaacagagggctcccggtcagcttcccaggcccttcgccctatgcccagagggcagactgcctctccctgggccggggtggcctgggtgccaggaggaggggagcataccccacaccctccctgccaccgttgccgttccagaacctcggtcagtgtttccctgtctgggggcagggcccagagcgagcacgcgtctggcggctgctgtcgttgtgttctaccccgtactgacccaacaccacaagggctttctctggtcccctgtccctaagacaataatcgctttctgacaaaggagcctgcacatttgggtgagcagacccaagctgtttacagctctttcttgtcctgccatccagtagcagttagtcttcatccccacgtgaacaaaatgggaaggagccgtgaggagaggagtgaggcaacaggcacccgaagtccctcgtccttccctctgtgtgctctgaatatgtccttgtccttcctgacccatctctgaccagctgggaacctgcttggggtccccctcaaacctgtgtctggggtgtgggctcacagatccctatcagcctggttcgtgggagggctcttcctaaagggacccccatctctaagtcactctgaaagggagttgtggagaggagacgcctccagactctcagaagttttgaggactgaactgggtcactcgggatctgtgttcgaatcctccccacccctttctttgtggagtttcctaacctgctgctgaagcacaatgttttggtgctttcttttctcatttgttaaaggcagtgtccaaaagccattccagatgccaagaccaggggcttatttctagggaaggtaggtcggtttccatgtttccctcccgttatttttattttttactttttgcctgagacaagccgagtatgaggtggtttgatttaagaaaaatcaatgaaattgtttactactgttttaaaataaaaccgtaaactctg

SEQ ID NO: 1995 - DNA, 1931 bp, Homo sapiens
ggcagcggacggacagtgctcgctccccgcttcatggcggccggtgaccctcacccacgtcgaatatcctgcaggtgatctctctggccacctccttgcctacctgagcctcagccctgtatttgtcatcgtcggtttcgtgaccctcatcatatttaagcgggagctgcacacggcccccacacagcagtgggcaccaagtacgggatgccctccagccattcccagtttatgtggttcttctccgtctattccttccttttcctgtatttaagaatgcaccaaacaaacaacgccaggttcctggacttgctgtggaggcacgtgctctccctgggactcctcgctgtggccttcctagtctcctacagcaggcctgtctccgagttcttcctaatccgagacacaagcctcattcccaacgtactctggtttgagtacacggtaacccgggcagaagccaggaacagacaacgcaagctggggacgaaactgcagtgaccagtgggtgtggctgggtccagcctccagatctggcccgcacgatgccttgcaggatggacaggatgacagacagggacgaagcagagacctctacagacccaagtcaccaagtggagcctttttttttcttattttaattttaatgaacaaggtggaccaaagggctgaaccagcccctcaaccaggaccctggggggcctgctgcctgggggccgtggccagagaccctcgctgtgctgctgccagcccctggctgggcagaaagtgccctcggcatgggcacctgggtgtggggtggaggaggagggctcgcgcctctggtctcggggccaggaattccaggtggcgtgagaagtacacactatttattttttggttttgtcagaggcaggcaggattttggagctggaagaatctgctctccggtggctgccctgtgaacagagggctcccggtcagcttcccaggcccttcgccctatgcccagagggcagactgcctctccctgggccggggtggcctgggtgccaggaggaggggagcataccccacaccctccctgccaccgttgccgttccagaacctcggtcagtgtttccctgtctgggggcagggcccagagcgagcacgcgtctggcggctgctgtcgttgtgttctaccccgtactgacccaacaccacaagggctttctctggtcccctgtccctaagacaataatcgctttctgacaaaggagcctgcacatttgggtgagcagacccaagctgtttacagctctttcttgtcctgccatccagtagcagttagtcttcatccccacgtgaacaaaatgggaaggagccgtgaggagaggagtgaggcaacaggcacccgaagtccctcgtccttccctctgtgtgctctgaatatgtccttgtccttcctgacccatctctgaccagctgggaacctgcttggggtccccctcaaacctgtgtctggggtgtgggctcacagatccctatcagcctggttcgtgggagggctcttcctaaagggacccccatctctaagtcactctgaaagggagttgtggagaggagacgcctccagactctcagaagttttgaggactgaactgggtcactcgggatctgtgttcgaatcctccccacccctttctttgtggagtttcctaacctgctgctgaagcacaatgttttggtgctttcttttctcatttgttaaaggcagtgtccaaaagccattccagatgccaagaccaggggcttatttctagggaaggtaggtcggtttccatgtttccctcccgttatttttattttttactttttgcctgagacaagccgagtatgaggtggtttgatttaagaaaaatcaatgaaattgtttactactgttttaaaataaaaccgtaaactctggc

SEQ ID NO: 1996 - DNA, 2205 bp, Homo sapiens
attcatcttggaaccgggcaattggcatttccgctctgggtagtacatctttaacataatgttagggaagtatccgttcttggctgcctttctttaattgcgtttccagtactctctcggtgattctactcttgaacataggatgaaatttggaatcacacttctcttccacttccatccccaccctctaatgcccatattaaaaatggcggccgccgccttccgcagtaatggttgttcagcgaacaagatccgggcggaaacagtagataggcgggtgcagcggggcagaacataggttgccttagagaggttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttcttattg

SEQ ID NO: 1997 - DNA, 3274 bp, Homo sapiens
gtgcatgggtttggaaccagagtaccttgcccacagaaatggaagtctggggacccagttggatttctacaacctccagccttagcggcacccttttctctgatccgggaggggaagagaagccatagggttccccagtttatgcccaccctcgtctggcctcctagcacgagcagtcagtccctcccctggaaggaaaggctgaagggaccacccaagcgcttggtccaactcaccccgtttctgcaggcctgctcgttcagcgctcgcacccaagcccgctgccagttctcccggaaagacttgaaggcgaagagtgacgccaggaggccccggactcctggctcctcggcggcgccagcccgagtcgcccgcagccgcagcagcgagcgccacacgcccagctcccgcagggaacccgcgggttccccggctaaggcgggtcccgggccccggtccccgcgggcccgcgccagccacaagccccgggcatattgcagcagccaggcgaacaccgtgagcagcgaggcggcgaagaggatcagcaaggccgcccagcccacgtcccgctgcccccagcccggatccatgctccgcgcgggctccgatcccggtcccggctggggctcacccgctgccccgggggagcatggcccgggcgggccgcggggaggaggtgggctcccccggggctgggcgcgcggggtcgggggctctccgcggctgagtgcccaggactagtgggtgccacagggcgaggagaggaggtcctcgggggtcgcgatgccggggtctctgtctccgtggtccgggtctctcctagcttggtcagcagtcggacccgttagtcgccggccagtgcccgactcctcccaccgcgcgggccccgccggaccctggaggggactggtctgcagagacgctggggctcgcgggccggcaccggctccgggagggctgcgtgcgcagagctgacactgacaacaccgccggcgccccgcccccacccgcccttaaaggagccgcacccgcgccgggcggggccaggacagcctggcgctccctcgctggaggagggcgggagggctagcagcgagcggaggaggttccggggttgaaaataggcgggatctttgatcacctcgccccatcttgcaatcgcggtgctcccacactcagctcaaggtttcctgcaagaaacaggcgcgtctccacaccctcgtccctcctccccaccccctgcctttcaatagccatcttcctggagccggaggcatcccagattaagggagaggtacgggccctttaagcttgacctatggaggcggacggagctaaaactgacgtggaaccggaatgtgagcggtgtcagacacgtggtacaaggaggcattcatcttggaaccgggcaattggcatttccgctctggattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttcttattgttta

SEQ ID NO: 1998 - DNA, 1770 bp, Homo sapiens
agtagataggcgggtgcagcggggcagaacataggttgccttagagaggttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagattttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcaggtgaggatgggaatcgagtttatacctccgtgtctccctttctgcgtgattcttactccagtccatttctccttgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggcca

SEQ ID NO: 1999 - DNA, 1542 bp, Homo sapiens
gtcccggtccgaaacgtgtctgggctgctgcgagagacagtcggtgaaggaagggaggggacatccgaagggtggcccgggaggccgggcgatggtgaggagggcgcctcctctccaccaaatcctccccatccatgcgggctagggacagaccctcccccgcccaccctaggctggaaagtgaacgttctctgcacctctcccacctacagactaagtagggcacccggtttccgtgtcggcttcaccactgactcggaatgggatctacctttctctgagcctcacttttcccatctgaaaaatggaacttccgatcccgcactcccatcccactctggccccgggactctgggatacttagagattggcttttggtggggcggcgacaggactgtggccatgaaggccagggagtctgggtccccaactcggtcccattccctagagagattcgggcagcaaccggccccacaatgctcttgagaactacacttcgccgatatgcaaagaagaggaggcggttcctgctcgtctccgacgaggtgggcccgagcaggcctggggactacgactcccggcgtgctccgcagtccaaagccggaagagcgtggacccggaaccggatgtggcttgcggctcgggtggctgagcgcgcggggaaatggccacggggacagaccaggtggtgggactcggcctcgtcgccgttagcctgatcatcttcacctactacaccgcctgggtgattctcttgccattcatcgacagtcagcatgtcatccacaagtatttcctgccccgagcctatgctgtcgccatcccactggctgcaggcctcctgctgctcctgtttgtgggactgttcatctcctatgtgatgctgaagaccaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttctggacctggaaagcctggggaaggactgacagaccccaggaccagccctggggctcagggcagccaccccgggccgctgaccgactgacctctcctcacggaggcccagccccaaagccccagggctggcccgtttgggacagctgaccaataaacactgatggtgtgtt

SEQ ID NO: 2000 - DNA, 738 bp, Homo sapiens
cgggtggctgagcgcgcggggaaatggccacggggacagaccaggtggtgggactcggcctcgtcgccgttagcctgatcatcttcacctactacaccgcctgggtgattctcttgccattcatcgacagtcagcatgtcatccacaagtatttcctgccccgagcctatgctgtcgccatcccactggctgcaggcctcctgctgctcctgtttgtgggtaagtcatcacctcctccccttgaccctgggcagggtttcgggaagaccccacctctgaacatgcttccacactttggcggtgctggaagctgcttgccccgaactcacccgtggggttttcctgttcatccttcgaggctgccagtcagtaacctctgggtttcctggtgccccaggctttttggactccaatgacctgtctacctctttcctgccccaaccccatcatcactctgctcacacctcagtcaccctcttgtcaccctggcttctaattcctgcacctctctctctcatggcttcctagggatggggactgtgtctccatcattactgcacatctagaacaggctgtggcactgaggctgtgctcagaaagtcatttggatgagtcagtcaacagccgggtgcctggatgatgggtggatggatgggtgggtgggtgaggtgtaggaggaggtgggtaggtatgtaggtggacagacaagtggttgaccgggtgatcgatagatgggtg

SEQ ID NO: 2001 - DNA, 7611 bp, Homo sapiens
cgagcacggtgcactctgggagctgtcactaggcccttcggctcccggtctcggtgtagctgccgtggttgccaggagagctgcgccggcgagaagcggccgagccagcagcaggaaggaacacacaagtagttatctttcaggctgtctttgaatacttccatgaccctgaacactagctgaggagagtttcaaccactgctaacagtaatgactttacatgagtttggaactggtctctagtgggaagttgtgggaggatgaacacagaagagctggagttattgagtgactccaaatacagaaactatgtagcagcaattgacaaagcactaaagaattttgaatactccagtgaatgggcagatttgatatcagcacttggaaaacttaataaggttttacaaaataatgcaaagtaccaagtagtacccaaaaagctgaccataggcaaacgcctagctcaatgtctacatccagcattaccaggtggagttcatcggaaggcgcttgaaacatatgaaattatcttcaaaataattggacctaagcgacttgccaaagatctttttttatatagttctggattatttcctcttcttgcaaatgctgccatgtctgtgaaaccaacattgctcagtttgtatgagatatattatctgcctttgggtaaaacactgaaacctggtctacagggattgcttactggtattcttcctggcttagaagaaggatcagagtactatgagagaacaaatatgttgttggaaaaggttgctgctgctgtggaccagtcagcattctacagtgccctgtggggtagtcttctcaccagtcctgctgtgcgtttacctggaatcacgtatgttcttgcccatttaaacaggaagctttctatggaagatcaactttatataattggcagtgatattgagctaatggtagaagcagtaagtacttcagtgcaggactcaagtgtacttgtacagagaagcacactggacctcatactcttctgttttccattccacatgagtcaggccactcgaccggatatgatcaggatcttgtcagcagcccttcatgtagtgctaaggagggatatgtctctgaatcgaagactttatgcatggcttcttggacccagaagcacaagacacagtaatcctgaagaacatgccacttactatttcactaccttttcaaaagaattattagtccaggcaatggtgggaatcttacaagtgaatggatttggagaagagaacactctaatgcaggatctaaagccttttcgcattttaatcagtttactggacaaacctgagctaggacctgtaattctagaagatgtcctgattgaagtgtttagaacattatattctcaatgcaaagcagagttggatcttcaaactgaaccacccttcagcaaggatcatgctcagttaagcagtaaattaagagaaaataagaaaacagcagagctgattaaaactgctaaccttctctttaattccttcgaaccttattatatgtgggattatgttgcacgctggtttgaagaatgttgtaggaggacactgcatgtgagacttcagattggacctggagatagtaatgactcatctgaattacagctgaccaatttctgcttactggtggattttttgttggacatagtttctttggagacttacattgaaatccagacagaacacttgccccagttgctgctcagaatgatttctgccttgacaagccatctccagacattgcacttatctgaactcacagattctctcagactctgctcaaagatccttagcaaggttcagcctccactgttatctgctagcactggaggtgttttgcagtttccaagtgggcagaacaattcagtcaaagagtgggaagacaaaaaggtatcatcagtttctcatgaaaatcctactgaagtgtttgaagatggagaaaatccaccaagtagtcgatcatcagagagtggattcactgagtttatacaatatcaagcagaccgaactgatgatattgacagagaactgagtgagggccagggggcagctgccatcccaattggtagcacatcctctgagacagaaacagcatccactgtgggatctgaagaaaccatcatccagaccccttccgtagtcactcaggggacagcaacccgaagtaggaagacagcccaaaagactgcaatgcagtgctgcttggagtatgtccaacagtttcttaccagacttatcaacctctacatcattcagaataactctttttctcagtctttggctacagaacatcaaggggatcttggtcgagaacaaggagagacttcaaaatgggacagaaattcacaaggagatgtaaaagagaaaaacataagtaaacaaaaaacttctaaagaatacctgtctgccttccttgctgcctgtcagctcttcctagagtgctcaagtttcccagtttacattgctgaggggaaccatacatcagagttacgttctgaaaaattggagactgactgtgagcatgtgcagcctccacagtggctccagactctgatgaatgcttgcagccaagcaagtgatttcagtgttcagagtgttgctatttcactagttatggacctggtgggactgacacagtctgtggccatggtcactggggaaaacatcaacagtgtagagcctgcacaacccttaagtccaaaccagggaagagtagctgtggttattagacctcccctcactcagggcaatctgaggtacatagctgagaagactgaatttttcaagcatgtagctttaacattgtgggaccagttgggagatgggacacctcagcatcaccagaagagtgtggaactattttatcaattacataacttagttccttcttctagcatctgtgaggatgttataagtcagcagttaacccataaagataagaaaataaggatggaagcacatgccaagtttgcagttctttggcatctaacgagagatctccatataaataaatcttcatcttttgtacgttcttttgacaggtcactgttcatcatgttagatagccttaacagtctcgatggttctactagctctgtgggacaagcctggctgaaccaagtcctacaaagacatgatattgcacgagttttggaaccattgctattgctcctgcttcatccaaaaactcagagggtttcagtacagcgtgtacaagcagaacgttattggaataagtctccctgttatccaggagaggagagtgacaagcatttcatgcaaaattttgcctgcagcaatgtgagccaagtacaactcatcacatcaaaaggaaatggtgaaaagccacttaccatggatgaaatagagaactttagtctcactgtgaatccattaagtgacagactttccctcctaagtaccagcagtgagacaattccaatggttgtgtctgattttgatcttccagaccaacagatagaaatacttcagagttctgactcgggatgttcacagtcctctgctggggacaacttgagttacgaagttgatcctgaaaccgtgaatgcccaagaggattctcaaatgcccaaggaaagctccccagatgatgatgttcaacaggtagtatttgacctgatatgtaaagttgtaagtggcctcgaagtggaatctgcatcagttacatctcaattagaaattgaagctatgcccccaaagtgcagtgatatagatccagatgaagagacgattaaaattgaagatgactccattcaacagagtcagaatgctttgctgagtaatgaaagttctcagtttctgtctgtgtctgcagagggaggccatgagtgtgtggcaaatggaatctccaggaatagctcctcaccttgtatttcaggaaccacacacactcttcatgactcttctgttgcttccatagaaaccaaatctagacaaaggagtcacagtagtattcaattcagcttcaaagaaaaattatcagaaaaagtttcggagaaggaaacaatagttaaggagtcaggtaaacaaccaggagcaaaacctaaagtaaaacttgccagaaaaaaggatgatgacaagaaaaaatcttcaaatgaaaaactcaaacaaaccagtgtattcttcagtgatggtctggatttagagaactggtatagctgtggagagggagacatttctgaaattgagagtgacatgggttctccaggatctcgaaaatctcccaatttcaacattcatcctctctatcaacatgtgctcctgtatctccagttgtatgattcatccaggactttgtatgctttctctgccatcaaagccatcttgaaaactaaccctatagcttttgtaaatgccatttcaactactagtgtaaataatgcatatactcctcagttgtctctccttcagaatctattggccagacaccggatttctgttatgggcaaagatttttatagtcacattccagtggactcaaatcataacttccggagttctatgtacatagaaattcttatttctctctgcttatattacatgcgtagccattacccaactcatgtcaaggttactgcacaagatttaataggcaatcgaaacatgcaaatgatgagcatagaaattctgacactactcttcactgagctggcaaaagtaatagaaagctcagcgaagggtttccctagttttatttctgatatgttatctaagtgcaaagttcagaaagtgattcttcattgtttgctgtcatctatctttagtgctcagaaatggcatagtgaaaaaatggcaggtaagaacctggttgctgtggaagaaggtttctcagaggacagccttattaatttctcagaggatgaatttgacaatggcagcacgttgcagtcacaacttcttaaggtgcttcagaggctgattgttctagaacacagagtaatgactattcctgaagagaatgaaacaggttttgattttgttgtatctgacttagaacacatcagtccccatcaacccatgacttctcttcagtatttgcatgctcagccaatcacatgtcaaggcatgttcctctgtgcagtgatacgagctttgcatcagcactgtgcatgtaagatgcacccacaatggattggtttaatcacatctactctgccttacatgggaaaagttctgcagagagtggttgtttctgtgacactacaactgtgcagaaatttagataatctaattcagcagtacaaatacgaaacaggattatctgatagtaggcctctgtggatggcatcaattattccaccagatatgattcttactcttttggaagggattacagccattatccattactgtttgttggatccaactacacagtatcaccaacttttggtcagtgtagaccagaaacacttgtttgaagcacgcagtggaatcctctcaatccttcatatgatcatgtcctctgtgacactgctttggagcatactgcatcaagctgattcttcagaaaagatgactattgccgcatccgcatctcttaccactattaatcttggagctacaaagaacttgagacaacagattcttgaattgttgggccccatttcaatgaatcatggtgttcactttatggctgccattgcatttgtgtggaatgaaagaagacagaataaaacaaccaccaggaccaaggtcattcctgcagccagtgaagaacagcttttattagtggaattggttcgttcaatcagtgtcatgagagcagaaactgttatccagactgtaaaagaagttttaaagcagccaccagccatagccaaggacaagaaacatctttctttggaagtctgcatgcttcagtttttctatgcttatattcaaagggttctgaatgagtttattatgaaaaaccctagtttggaaaataaaaaagaccaaagagaccttcaggatgtaactcacaaaatagtggatgcaattggtgcaattgctggttcttctctggaacagacaacatggctgcgacgaaatcttgaagttaagccttctcccaaaataatggtagatggaaccaatttggaatctgatgttgaaggtattcttgtcaaacatttaggtttattatctgttttggctcatcttttggatatggttttctatagtgatgaaaaggagcgggttattcctttacttgtaaatattatgcattatgttgtgccctacctcagaaatcacagtgcacataatgcccctagttatcgagcttgtgtccagctgctcagcagtcttagtgggtatcagtacacacggagagcttggaaaaaagaagcttttgacctctttatggatcccagtttctttcagatggatgcctcttgtgttaatcattggagagcaattatggacaatctgatgacacatgataaaacaacatttagagatttgatgactcgtgtagcagtggctcaaagcagttcacttaatctctttgcaaaccgtgatgtggagctagaacagagagctatgcttcttaaaagattagcatttgctatttttagcagtgaaattgaccagtaccagaaatatcttccagatatacaaggaattcctgtgagtaaatgggtccagctgctgacagcactgtctcctgcttacaggacttcagggccctctgtggctggtctggagacaacgtacacaggaggtaatggcttctctacttcatataacagccagcggtggttaaacctctatctctctgcttgcaaatttttggatttggctctcgcattgccctctgaaaaccttcctcagtttcagatgtaccgatgggcctttattccagaagcctcagatgattcaggtttggaagtcagaaggcagggtatacatcaacgagaatttaaaccttacgtggtacgactagcaaaacttcttcggaaaagagcaaaggacaaggaggaggactttaagacagtgattttggagggattggagatggccaagcatcagaaaaatccagaggaagacaactcagggagaacattgggttgggagccagggcacttgctgctcaccatctgcaccgtgcgcagtatggagcagctcctgccgttcttcaatgtgctcagtcaagtcttcaacagcaaagtcacaagccgatgtggaggacactcagggagtcctatcctctactcaaatgccttccctaataaggacatgaaactggagaaccacaaaccatgttccagcaaagccaggcaaaaaatagaagagatggtagaaaaagattttctggaagggatgataaaaacttgagcaccattgctggttccatttagcttacatgtaaatgtaattatttaaaacacacacactgctctgcgttgtatagtttttccttttttgtatgtaacagaacacatttcagattgtatttaatttaaatatttgtatataagagcaaatgtctgaatgtggcctgaatcaagtttaaatattgttggctcatactgattatggtgcctaagagagctatatatatacacatgtaaagtcc

SEQ ID NO: 2002 - DNA, 8210 bp, Homo sapiens
cgagcacggtgcactctgggagctgtcactaggcccttcggctcccggtctcggtgtagctgccgtggttgccaggagagctgcgccggcgagaagcggccgagccagcagcaggaaggaacacacaagtagttatctttcaggctgtctttgaatacttccatgaccctgaacactagctgaggagagtttcaaccactgctaacagtaatgactttacatgagtttggaactggtctctagtgggaagttgtgggaggatgaacacagaagagctggagttattgagtgactccaaatacagaaactatgtagcagcaattgacaaagcactaaagaattttgaatactccagtgaatgggcagatttgatatcagcacttggaaaacttaataaggttttacaaaataatgcaaagtaccaagtagtacccaaaaagctgaccataggcaaacgcctagctcaatgtctacatccagcattaccaggtggagttcatcggaaggcgcttgaaacatatgaaattatcttcaaaataattggacctaagcgacttgccaaagatctttttttatatagttctggattatttcctcttcttgcaaatgctgccatgtctgtgaaaccaacattgctcagtttgtatgagatatattatctgcctttgggtaaaacactgaaacctggtctacagggattgcttactggtattcttcctggcttagaagaaggatcagagtactatgagagaacaaatatgttgttggaaaaggttgctgctgctgtggaccagtcagcattctacagtgccctgtggggtagtcttctcaccagtcctgctgtgcgtttacctggaatcacgtatgttcttgcccatttaaacaggaagctttctatggaagatcaactttatataattggcagtgatattgagctaatggtagaagcagtaagtacttcagtgcaggactcaagtgtacttgtacagagaagcacactggacctcatactcttctgttttccattccacatgagtcaggccactcgaccggatatgatcaggatcttgtcagcagcccttcatgtagtgctaaggagggatatgtctctgaatcgaagactttatgcatggcttcttggttttgataacaacggtgctatcataggacccagaagcacaagacacagtaatcctgaagaacatgccacttactatttcactaccttttcaaaagaattattagtccaggcaatggtgggaatcttacaagtgaatggatttggagaagagaacactctaatgcaggatctaaagccttttcgcattttaatcagtttactggacaaacctgagctaggacctgtaattctagaagatgtcctgattgaagtgtttagaacattatattctcaatgcaaagcagagttggatcttcaaactgaaccacccttcagcaaggatcatgctcagttaagcagtaaattaagagaaaataagaaaacagcagagctgattaaaactgctaaccttctctttaattccttcgaaccttattatatgtgggattatgttgcacgctggtttgaagaatgttgtaggaggacactgcatgtgagacttcagattggacctggagatagtaatgactcatctgaattacagctgaccaatttctgcttactggtggattttttgttggacatagtttctttgcctactagaagtatgagggtgctgtgtcaggagacttacattgaaatccagacagaacacttgccccagttgctgctcagaatgatttctgccttgacaagccatctccagacattgcacttatctgaactcacagattctctcagactctgctcaaagatccttagcaaggttcagcctccactgttatctgctagcactggaggtgttttgcagtttccaagtgggcagaacaattcagtcaaagagtgggaagacaaaaaggtatcatcagtttctcatgaaaatcctactgaagtgtttgaagatggagaaaatccaccaagtagtcgatcatcagagagtggattcactgagtttatacaatatcaagcagaccgaactgatgatattgacagagaactgagtgagggccagggggcagctgccatcccaattggtagcacatcctctgagacagaaacagcatccactgtgggatctgaagaaaccatcatccagaccccttccgtagtcactcaggggacagcaacccgaagtaggaagacagcccaaaagactgcaatgcagtgctgcttggagtatgtccaacagtttcttaccagacttatcaacctctacatcattcagaataactctttttctcagtctttggctacagaacatcaaggggatcttggtcgagaacaaggagagacttcaaaatgggacagaaattcacaaggagatgtaaaagagaaaaacataagtaaacaaaaaacttctaaagaatacctgtctgccttccttgctgcctgtcagctcttcctagagtgctcaagtttcccagtttacattgctgaggggaaccatacatcagagttacgttctgaaaaattggagactgactgtgagcatgtgcagcctccacagtggctccagactctgatgaatgcttgcagccaagcaagtgatttcagtgttcagagtgttgctatttcactagttatggacctggtgggactgacacagtctgtggccatggtcactggggaaaacatcaacagtgtagagcctgcacaacccttaagtccaaaccagggaagagtagctgtggttattagacctcccctcactcagggcaatctgaggtacatagctgagaagactgaatttttcaagcatgtagctttaacattgtgggaccagttgggagatgggacacctcagcatcaccagaagagtgtggaactattttatcaattacataacttagttccttcttctagcatctgtgaggatgttataagtcagcagttaacccataaagataagaaaataaggatggaagcacatgccaagtttgcagttctttggcatctaacgagagatctccatataaataaatcttcatcttttgtacgttcttttgacaggtcactgttcatcatgttagatagccttaacagtctcgatggttctactagctctgtgggacaagcctggctgaaccaagtcctacaaagacatgatattgcacgagttttggaaccattgctattgctcctgcttcatccaaaaactcagagggtttcagtacagcgtgtacaagcagaacgttattggaataagtctccctgttatccaggagaggagagtgacaagcatttcatgcaaaattttgcctgcagcaatgtgagccaagtacaactcatcacatcaaaaggaaatggtgaaaagccacttaccatggatgaaatagagaactttagtctcactgtgaatccattaagtgacagactttccctcctaagtaccagcagtgagacaattccaatggttgtgtctgattttgatcttccagaccaacagatagaaatacttcagagttctgactcgggatgttcacagtcctctgctggggacaacttgagttacgaagttgatcctgaaaccgtgaatgcccaagaggattctcaaatgcccaaggaaagctccccagatgatgatgttcaacaggtagtatttgacctgatatgtaaagttgtaagtggcctcgaagtggaatctgcatcagttacatctcaattagaaattgaagctatgcccccaaagtgcagtgatatagatccagatgaagagacgattaaaattgaagatgactccattcaacagagtcagaatgctttgctgagtaatgaaagttctcagtttctgtctgtgtctgcagagggaggccatgagtgtgtggcaaatggaatctccaggaatagctcctcaccttgtatttcaggaaccacacacactcttcatgactcttctgttgcttccatagaaaccaaatctagacaaaggagtcacagtagtattcaattcagcttcaaagaaaaattatcagaaaaagtttcggagaaggaaacaatagttaaggagtcaggtaaacaaccaggagcaaaacctaaagtaaaacttgccagaaaaaaggatgatgacaagaaaaaatcttcaaatgaaaaactcaaacaaaccagtgtattcttcagtgatggtctggatttagagaactggtatagctgtggagagggagacatttctgaaattgagagtgacatgggttctccaggatctcgaaaatctcccaatttcaacattcatcctctctatcaacatgtgctcctgtatctccagttgtatgattcatccaggactttgtatgctttctctgccatcaaagccatcttgaaaactaaccctatagcttttgtaaatgccatttcaactactagtgtaaataatgcatatactcctcagttgtctctccttcagaatctattggccagacaccggatttctgttatgggcaaagatttttatagtcacattccagtggactcaaatcataacttccggagttctatgtacatagaaattcttatttctctctgcttatattacatgcgtagccattacccaactcatgtcaaggttactgcacaagatttaataggcaatcgaaacatgcaaatgatgagcatagaaattctgacactactcttcactgagctggcaaaagtaatagaaagctcagcgaagggtttccctagttttatttctgatatgttatctaagtgcaaagttcagaaagtgattcttcattgtttgctgtcatctatctttagtgctcagaaatggcatagtgaaaaaatggcaggtaagaacctggttgctgtggaagaaggtttctcagaggacagccttattaatttctcagaggatgaatttgacaatggcagcacgttgcagtcacaacttcttaaggtgcttcagaggctgattgttctagaacacagagtaatgactattcctgaagagaatgaaacaggttttgattttgttgtatctgacttagaacacatcagtccccatcaacccatgacttctcttcagtatttgcatgctcagccaatcacatgtcaaggcatgttcctctgtgcagtgatacgagctttgcatcagcactgtgcatgtaagatgcacccacaatggattggtttaatcacatctactctgccttacatgggaaaagttctgcagagagtggttgtttctgtgacactacaactgtgcagaaatttagataatctaattcagcagtacaaatacgaaacaggattatctgatagtaggcctctgtggatggcatcaattattccaccagatatgattcttactcttttggaagggattacagccattatccattactgtttgttggatccaactacacagtatcaccaacttttggtcagtgtagaccagaaacacttgtttgaagcacgcagtggaatcctctcaatccttcatatgatcatgtcctctgtgacactgctttggagcatactgcatcaagctgattcttcagaaaagatgactattgccgcatccgcatctcttaccactattaatcttggagctacaaagaacttgagacaacagattcttgaattgttgggccccatttcaatgaatcatggtgttcactttatggctgccattgcatttgtgtggaatgaaagaagacagaataaaacaaccaccaggaccaaggtcattcctgcagccagtgaagaacagcttttattagtggaattggttcgttcaatcagtgtcatgagagcagaaactgttatccagactgtaaaagaagttttaaagcagccaccagccatagccaaggacaagaaacatctttctttggaagtctgcatgcttcagtttttctatgcttatattcaaagaattccagtgcccaatttagtggatagctgggcgtcactgttgatacttctgaaagactctatacaactgagtcttccagctccagggcagtttcttatacttggggttctgaatgagtttattatgaaaaaccctagtttggaaaataaaaaagaccaaagagaccttcaggatgtaactcacaaaatagtggatgcaattggtgcaattgctggttcttctctggaacagacaacatggctgcgacgaaatcttgaagttaagccttctcccaaaataatggtagatggaaccaatttggaatctgatgttgaagatatgttatcacctgcaatggaaaccgcaaacataactccttctgtatatagtgtccatgcattgacattactctctgaggttttggctcatcttttggatatggttttctatagtgatgaaaaggagcgggttattcctttacttgtaaatattatgcattatgttgtgccctacctcagaaatcacagtgcacataatgcccctagttatcgagcttgtgtccagctgctcagcagtcttagtgggtatcagtacacacggagagcttggaaaaaagaagcttttgacctctttatggatcccagtttctttcagatggatgcctcttgtgttaatcattggagagcaattatggacaatctgatgacacatgataaaacaacatttagagatttgatgactcgtgtagcagtggctcaaagcagttcacttaatctctttgcaaaccgtgatgtggagctagaacagagagctatgcttcttaaaagattagcatttgctatttttagcagtgaaattgaccagtaccagaaatatcttccagatatacaagagagattggttgagagtctccgtttgccacaggtgccaactctccattctcaagtgttcctgtttttcagagtgttacttttaagaatgtctccccaacatcttacctcactctggcctaccatgattacagaacttgtacaagtatttttactgatggagcaggaactcactgctgatgaagatatttcacggacttcagggccctctgtggctggtctggagacaacgtacacaggaggtaatggcttctctacttcatataacagccagcggtggttaaacctctatctctctgcttgcaaatttttggatttggctctcgcattgccctctgaaaaccttcctcagtttcagatgtaccgatgggcctttattccagaagcctcagatgattcaggtttggaagtcagaaggcagggtatacatcaacgagaatttaaaccttacgtggtacgactagcaaaacttcttcggaaaagagcaaagaaaaatccagaggaagacaactcagggagaacattgggttgggagccagggcacttgctgctcaccatctgcaccgtgcgcagtatggagcagctcctgccgttcttcaatgtgctcagtcaagtcttcaacagcaaagtcacaagccgatgtggaggacactcagggagtcctatcctctactcaaatgccttccctaataaggacatgaaactggagaaccacaaaccatgttccagcaaagccaggcaaaaaatagaagagatggtagaaaaagattttctggaagggatgataaaaacttgagcaccattgctggttccatttagcttacatgtaaatgtaattatttaaaacacacacactgctctgcgttgtatagtttttccttttttgtatgtaacagaacacatttcagattgtatttaatttaaatatttgtatataagagcaaatgtctgaatgtggcctgaatcaagtttaaatattgttggctcatactgattatggtgcctaagagagctatatatatacacatgtaaagtccattgtttttattgtcctgagttgtcttaaacctgcaaaatatacactacccattttttttttccattggtttcagacttggttcaattaagattggttggggatttttctcttttccttattaaccatgttctggtatcagaatggtgttccttctccatcagaggctgggaaacgtattataattagtttttctcccacataccttcaccaagagcagtgaagaataactgaaggctggaccatgcatccttaaaagtattgcatgagcatctccacctcagtatggaagagggatggacaaccccctat

SEQ ID NO: 2003 - DNA, 7562 bp, Homo sapiens
aggaaggaacacacaagtagttatctttcaggctgtctttgaatacttccatgaccctgaacactagctgaggagagtttcaaccactgctaacagtaatgactttacatgagtttggaactggtctctagtgggaagttgtgggaggatgaacacagaagagctggagttattgagtgactccaaatacagaaactatgtagcagcaattgacaaagcactaaagaattttgaatactccagtgaatgggcagatttgatatcagcacttggaaaacttaataaggttttacaaaataatgcaaagtaccaagtagtacccaaaaagctgaccataggcaaacgcctagctcaatgtctacatccagcattaccaggtggagttcatcggaaggcgcttgaaacatatgaaattatcttcaaaataattggacctaagcgacttgccaaagatctttttttatatagttctggattatttcctcttcttgcaaatgctgccatgtctgtgaaaccaacattgctcagtttgtatgagatatattatctgcctttgggtaaaacactgaaacctggtctacagggattgcttactggtattcttcctggcttagaagaaggatcagagtactatgagagaacaaatatgttgttggaaaaggttgctgctgctgtggaccagtcagcattctacagtgccctgtggggtagtcttctcaccagtcctgctgtgcgtttacctggaatcacgtatgttcttgcccatttaaacaggaagctttctatggaagatcaactttatataattggcagtgatattgagctaatggtagaagcagtaagtacttcagtgcaggactcaagtgtacttgtacagagaagcacactggacctcatactcttctgttttccattccacatgagtcaggccactcgaccggatatgatcaggatcttgtcagcagcccttcatgtagtgctaaggagggatatgtctctgaatcgaagactttatgcatggcttcttggacccagaagcacaagacacagtaatcctgaagaacatgccacttactatttcactaccttttcaaaagaattattagtccaggcaatggtgggaatcttacaagtgaatggatttggagaagagaacactctaatgcaggatctaaagccttttcgcattttaatcagtttactggacaaacctgagctaggacctgtaattctagaagatgtcctgattgaagtgtttagaacattatattctcaatgcaaagcagagttggatcttcaaactgaaccacccttcagcaaggatcatgctcagttaagcagtaaattaagagaaaataagaaaacagcagagctgattaaaactgctaaccttctctttaattccttcgaaccttattatatgtgggattatgttgcacgctggtttgaagaatgttgtaggaggacactgcatgtgagacttcagattggacctggagatagtaatgactcatctgaattacagctgaccaatttctgcttactggtggattttttgttggacatagtttctttggagacttacattgaaatccagacagaacacttgccccagttgctgctcagaatgatttctgccttgacaagccatctccagacattgcacttatctgaactcacagattctctcagactctgctcaaagatccttagcaaggttcagcctccactgttatctgctagcactggaggtgttttgcagtttccaagtgggcagaacaattcagtcaaagagtgggaagacaaaaaggtatcatcagtttctcatgaaaatcctactgaagtgtttgaagatggagaaaatccaccaagtagtcgatcatcagagagtggattcactgagtttatacaatatcaagcagaccgaactgatgatattgacagagaactgagtgagggccagggggcagctgccatcccaattggtagcacatcctctgagacagaaacagcatccactgtgggatctgaagaaaccatcatccagaccccttccgtagtcactcaggggacagcaacccgaagtaggaagacagcccaaaagactgcaatgcagtgctgcttggagtatgtccaacagtttcttaccagacttatcaacctctacatcattcagaataactctttttctcagtctttggctacagaacatcaaggggatcttggtcgagaacaaggagagacttcaaaatgggacagaaattcacaaggagatgtaaaagagaaaaacataagtaaacaaaaaacttctaaagaatacctgtctgccttccttgctgcctgtcagctcttcctagagtgctcaagtttcccagtttacattgctgaggggaaccatacatcagagttacgttctgaaaaattggagactgactgtgagcatgtgcagcctccacagtggctccagactctgatgaatgcttgcagccaagcaagtgatttcagtgttcagagtgttgctatttcactagttatggacctggtgggactgacacagtctgtggccatggtcactggggaaaacatcaacagtgtagagcctgcacaacccttaagtccaaaccagggaagagtagctgtggttattagacctcccctcactcagggcaatctgaggtacatagctgagaagactgaatttttcaagcatgtagctttaacattgtgggaccagttgggagatgggacacctcagcatcaccagaagagtgtggaactattttatcaattacataacttagttccttcttctagcatctgtgaggatgttataagtcagcagttaacccataaagataagaaaataaggatggaagcacatgccaagtttgcagttctttggcatctaacgagagatctccatataaataaatcttcatcttttgtacgttcttttgacaggtcactgttcatcatgttagatagccttaacagtctcgatggttctactagctctgtgggacaagcctggctgaaccaagtcctacaaagacatgatattgcacgagttttggaaccattgctattgctcctgcttcatccaaaaactcagagggtttcagtacagcgtgtacaagcagaacgttattggaataagtctccctgttatccaggagaggagagtgacaagcatttcatgcaaaattttgcctgcagcaatgtgagccaagtacaactcatcacatcaaaaggaaatggtgaaaagccacttaccatggatgaaatagagaactttagtctcactgtgaatccattaagtgacagactttccctcctaagtaccagcagtgagacaattccaatggttgtgtctgattttgatcttccagaccaacagatagaaatacttcagagttctgactcgggatgttcacagtcctctgctggggacaacttgagttacgaagttgatcctgaaaccgtgaatgcccaagaggattctcaaatgcccaaggaaagctccccagatgatgatgttcaacaggtagtatttgacctgatatgtaaagttgtaagtggcctcgaagtggaatctgcatcagttacatctcaattagaaattgaagctatgcccccaaagtgcagtgatatagatccagatgaagagacgattaaaattgaagatgactccattcaacagagtcagaatgctttgctgagtaatgaaagttctcagtttctgtctgtgtctgcagagggaggccatgagtgtgtggcaaatggaatctccaggaatagctcctcaccttgtatttcaggaaccacacacactcttcatgactcttctgttgcttccatagaaaccaaatctagacaaaggagtcacagtagtattcaattcagcttcaaagaaaaattatcagaaaaagtttcggagaaggaaacaatagttaaggagtcaggtaaacaaccaggagcaaaacctaaagtaaaacttgccagaaaaaaggatgatgacaagaaaaaatcttcaaatgaaaaactcaaacaaaccagtgtattcttcagtgatggtctggatttagagaactggtatagctgtggagagggagacatttctgaaattgagagtgacatgggttctccaggatctcgaaaatctcccaatttcaacattcatcctctctatcaacatgtgctcctgtatctccagttgtatgattcatccaggactttgtatgctttctctgccatcaaagccatcttgaaaactaaccctatagcttttgtaaatgccatttcaactactagtgtaaataatgcatatactcctcagttgtctctccttcagaatctattggccagacaccggatttctgttatgggcaaagatttttatagtcacattccagtggactcaaatcataacttccggagttctatgtacatagaaattcttatttctctctgcttatattacatgcgtagccattacccaactcatgtcaaggttactgcacaagatttaataggcaatcgaaacatgcaaatgatgagcatagaaattctgacactactcttcactgagctggcaaaagtaatagaaagctcagcgaagggtttccctagttttatttctgatatgttatctaagtgcaaagttcagaaagtgattcttcattgtttgctgtcatctatctttagtgctcagaaatggcatagtgaaaaaatggcaggtaagaacctggttgctgtggaagaaggtttctcagaggacagccttattaatttctcagaggatgaatttgacaatggcagcacgttgcagtcacaacttcttaaggtgcttcagaggctgattgttctagaacacagagtaatgactattcctgaagagaatgaaacaggttttgattttgttgtatctgacttagaacacatcagtccccatcaacccatgacttctcttcagtatttgcatgctcagccaatcacatgtcaaggcatgttcctctgtgcagtgatacgagctttgcatcagcactgtgcatgtaagatgcacccacaatggattggtttaatcacatctactctgccttacatgggaaaagttctgcagagagtggttgtttctgtgacactacaactgtgcagaaatttagataatctaattcagcagtacaaatacgaaacaggattatctgatagtaggcctctgtggatggcatcaattattccaccagatatgattcttactcttttggaagggattacagccattatccattactgtttgttggatccaactacacagtatcaccaacttttggtcagtgtagaccagaaacacttgtttgaagcacgcagtggaatcctctcaatccttcatatgatcatgtcctctgtgacactgctttggagcatactgcatcaagctgattcttcagaaaagatgactattgccgcatccgcatctcttaccactattaatcttggagctacaaagaacttgagacaacagattcttgaattgttgggccccatttcaatgaatcatggtgttcactttatggctgccattgcatttgtgtggaatgaaagaagacagaataaaacaaccaccaggaccaaggtcattcctgcagccagtgaagaacagcttttattagtggaattggttcgttcaatcagtgtcatgagagcagaaactgttatccagactgtaaaagaagttttaaagcagccaccagccatagccaaggacaagaaacatctttctttggaagtctgcatgcttcagtttttctatgcttatattcaaagggttctgaatgagtttattatgaaaaaccctagtttggaaaataaaaaagaccaaagagaccttcaggatgtaactcacaaaatagtggatgcaattggtgcaattgctggttcttctctggaacagacaacatggctgcgacgaaatcttgaagttaagccttctcccaaaataatggtagatggaaccaatttggaatctgatgttgaaggtattcttgtcaaacatttaggtttattatctgttttggctcatcttttggatatggttttctatagtgatgaaaaggagcgggttattcctttacttgtaaatattatgcattatgttgtgccctacctcagaaatcacagtgcacataatgcccctagttatcgagcttgtgtccagctgctcagcagtcttagtgggtatcagtacacacggagagcttggaaaaaagaagcttttgacctctttatggatcccagtttctttcagatggatgcctcttgtgttaatcattggagagcaattatggacaatctgatgacacatgataaaacaacatttagagatttgatgactcgtgtagcagtggctcaaagcagttcacttaatctctttgcaaaccgtgatgtggagctagaacagagagctatgcttcttaaaagattagcatttgctatttttagcagtgaaattgaccagtaccagaaatatcttccagatatacaaggaattcctgtgagtaaatgggtccagctgctgacagcactgtctcctgcttacaggacttcagggccctctgtggctggtctggagacaacgtacacaggaggtaatggcttctctacttcatataacagccagcggtggttaaacctctatctctctgcttgcaaatttttggatttggctctcgcattgccctctgaaaaccttcctcagtttcagatgtaccgatgggcctttattccagaagcctcagatgattcaggtttggaagtcagaaggcagggtatacatcaacgagaatttaaaccttacgtggtacgactagcaaaacttcttcggaaaagagcaaaggacaaggaggaggactttaagacagtgattttggagggattggagatggccaagcatcagaaaaatccagaggaagacaactcagggagaacattgggttgggagccagggcacttgctgctcaccatctgcaccgtgcgcagtatggagcagctcctgccgttcttcaatgtgctcagtcaagtcttcaacagcaaagtcacaagccgatgtggaggacactcagggagtcctatcctctactcaaatgccttccctaataaggacatgaaactggagaaccacaaaccatgttccagcaaagccaggcaaaaaatagaagagatggtagaaaaagattttctggaagggatgataaaaacttgagcaccattgctggttccatttagcttacatgtaaatgtaattatttaaaacacacacactgctctgcgttgtatagtttttccttttttgtatgtaacagaacacatttcagattgtatttaatttaaatatttgtatataagagcaaatgtctgaatgtggcctgaatcaagtttaaatattgttggctcatactgattatggtgcctaagagagctatatatatacacatgtaaagtccattgtttttattgtcctgagttgtcttaaacctgcaaaatatacactacccattttttttttc

SEQ ID NO: 2004 - DNA, 1859 bp, Homo sapiens
acggtgcactctgggagctgtcactaggcccttcggctcccggtctcggtgtagctgccgtggttgccaggagagctgcgccggcgagaagcggccgagccagcagcaggtaatgactttacatgagtttggaactggtctctagtgggaagttgtgggaggatgaacacagaagagctggagttattgagtgactccaaatacagaaactatgtagcagcaattgacaaagcactaaagaattttgaatactccagtgaatgggcagatttgatatcagcacttggaaaacttaataaggttttacaaaataatgcaaagtaccaagtagtacccaaaaagctgaccataggcaaacgcctagctcaatgtctacatccagcattaccaggtggagttcatcggaaggcgcttgaaacatatgaaattatcttcaaaataattggacctaagcgacttgccaaagatctttttttatatagttctggattatttcctcttcttgcaaatgctgccatgtctgtgaaaccaacattgctcagtttgtatgagatatattatctgcctttgggtaaaacactgaaacctggtctacagggattgcttactggtattcttcctggcttagaagaaggatcagagtactatgagagaacaaatatgttgttggaaaaggttgctgctgctgtggaccagtcagcattctacagtgccctgtggggtagtcttctcaccagtcctgctgtgcgtttacctggaatcacgtatgttcttgcccatttaaacaggaagctttctatggaagatcaactttatataattggcagtgatattgagctaatgaagcagtaagtacttcagtgcaggactcaagtgtacttgtacagagaagcacactggacctcatactcttctgttttccattccacatgagtcaggccactcgaccggatatgatcaggatcttgtcagcagcccttcatgtagtgctaaggagggatatgtctctgaatcgaagactttatgcatggcttcttggttttgataacaacggtgctatcataggacccagaagcacaagacacagtaatcctgaagaacatgccacttactatttcactaccttttcaaaagaattattagtccaggcaatggtgggaatcttacaagtgaatggatttggagaagagaacactctaatgcaggatctaaagccttttcgcattttaatcagtttactggacaaacctgagctaggacctgtaattctagaagatgtcctgattgaagtgtttagaacattatattctcaatgcaaagcagagttggatcttcaaactgaaccacccttcagcaaggatcatgctcagttaagcaggtggattatcaaaaaattaaatgtgacatgaagacataatatgtattcacttaatataaacttgaagtgtaataacttgggatcctactctatgaagtttgtgttctaataagtaaagctgatttaatactagtaaagctgatttaatactgacatactagttgtattgacagtgcctcactatataaagacaattgttttaattgttacaaaagacaggaggaggaaataggtaataggctaaagggttgccacttgaaataacaaagttctttttccctgatgcaatttcagtaatagtggctattaacagcactagttggttttgttgttgttgtttttcaaactaagaataataatttgattgaaactggtcaaggtaaacctttcttaagaaaatcctgaatagcacagggaagcagacaaaattcttcacaatcaaggctgtgaaaatcaaatcactactcagtttgtatgtgcc

SEQ ID NO: 2005 - DNA, 1765 bp, Homo sapiens
ttacatttacagtgtagcaaaagagaaagtaactatgttgctgctggagatcaatgaagccgagtgaatgggggctgaatgtgcgagtccatagctgaagaggagcgccagatggtggaggaatacacttatttatgaagtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaaaaaatcttggtgtgtttctgttgattgtgtaaaaatttattttcattatataaatgaaactgg

SEQ ID NO: 2006 - DNA, 2676 bp, Homo sapiens
ggattcttattggcccaacccgccgtcggtcggcggcgagtccgccccctcagaaccttacatttacagtgtagcaaaagagaaagtaactatgttgctgctggagatcaatgaagccgagtgaatgggggctgaatgtgcgagtccatagctgaagaggagcgccagatggtggaggaatacacttatttatgaaactgtcttgagttcttcttgaattgccagttttcagcctcctcatgcctccgtctcctttagacgacagggtagtagtggcactatctaggcccgtccgacctcaggatctcaacctttgtttagactctagttaccttggctctgccaacccaggcagtaacagccaccctcctgtcatcgccaccaccgttgtgtccctcaaggctgcgaatctgacgtatatgccctcatccagcggctctgcccgctcgctgaattgtggatgcagcagtgccagctgctgcactgtggcaacctacgacaaggacaatcaggcccaaacccaagccattgccgctggcaccaccaccactgccatcggaacctctaccacctgccctgctaaccagatggtcaacaataatgagaatacaggctctctaagtccatcaagtggggtgggcagccctgtgtcagggacccccaagcagctagccagcatcaaaataatctaccccaatgacttggcaaagaagatgaccaaatgcagcaagagtcacctgccgagtcagggccctgtcatcattgactgcaggcccttcatggagtacaacaagagtcacatccaaggagctgtccacattaactgtgccgataagatcagccggcggagactgcagcagggcaagatcactgtcctagacttgatttcctgtagggaaggcaaggactctttcaagaggatcttttccaaagaaattatagtttatgatgagaataccaatgaaccaagccgagtgatgccctcccagccacttcacatagtcctcgagtccctgaagagagaaggcaaagaacctctggtgttgaaaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaaaaaatcttggtgtgtttctgttgattgtgtaaaaatttattttcattatataaatgaaactgg

SEQ ID NO: 2007 - DNA, 2272 bp, Homo sapiens
atgcctccgtctcctttagacgacagggtagtagtggcactatctaggcccgtccgacctcaggatctcaacctttgtttagactctagttaccttggctctgccaacccaggcagtaacagccaccctcctgtcatcaccaccactgccatcggaacctctaccacctgccctgctaaccagatggtcaacaataatgagaatacaggctctctaagtccatcaagtggggtgggcagccctgtgtcagggacccccaagcagctagccagcatcaaaataatctaccccaatgacttggcaaagaagatgaccaaatgcagcaagagtcacctgccgagtcagggccctgtcatcattgactgcaggcccttcatggagtacaacaagagtcacatccaaggagctgtccacattaactgtgccgataagatcagccggcggagactgcagcagggcaagatcactgtcctagacttgatttcctgtagggaaggcaaggactctttcaagaggatcttttccaaagaaattatagtttatgatgagaataccaatgaaccaagccgagtgatgccctcccagccacttcacatagtcctcgagtccctgaagagagaaggcaaagaacctctggtgttgaaaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaaaaaatcttggtgtgtttctgttgattgtgtaaaaatttattttcattatataaatgaaactgg

SEQ ID NO: 2008 - DNA, 2244 bp, Homo sapiens
cttgtatggttgactttgagtgattcccaggatatttaccctgctattgtcttaccataatcttgatgtgtctagcctcttacaaatgagaaaatcctaccgaggaatttcccatttgtaatagtttgtcttggggagcaaagaggaggatagccaatgatcatgatgatctcctcttttctcacgcagagcaggtgttcatgataaaaagcaagtcttttgtgtcttcatgatctgaagagaggaaacaacacggatcaagatgatcctagacctcctaatcatggggatgattacaaggagttgcagaccctactctctattttgcagtgggtggagttgtggataggggtgacccatcagtcattgagaaatgaatctcctgggtgctacttgtgaaagtgaggatcctctctccctttcctgtggatgcagctgagattctggacagcctagacttcttcctcagtgtcagagtaagattgcctcaatggggcggggcaggacacactgctgacctcaccactgggcgccctgggcagccactgcgaggcctcgtcattttcgagttggtgagacaccgcggcagtcgacttggaagatgctctggtggtagaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaaaaaatcttggtgtgtttctgttgattgtgtaaaaatttattttcattatataaatgaaactgg

SEQ ID NO: 2009 - DNA, 1732 bp, Homo sapiens
gttgtcccgcgggccgtgggcccggcacactggggctttgtccggccccccgccgcgacccgaggcgggggccccacatgaccgaaggggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagggtgccagacataggacctcaaaaacctctggtgcccaatgccctccgatgacttcagcaacctgcctgctggctgcacgtgtggctcttctctccgcagcgctggtgcgcgaagccaccgggcgcacagcccagcgctgtcgtctgagtccgcgggcggccgccgagcgcctgctggggccgccacctcacgttgcagcaggatggtcaccggacccaaagtaccagatctgtctgtgcttcggtgaggaggacccgggccccacacagcaccccaaggagcagctcatcatggcggacgtgcaggtgcagcttcggcctgggagctcgtcctgcactctaagtgcctcaaccgagcgcccagatgggtcctcaacccctggcaaccccgatggcatcactcaccttcaatgcagctgcctccatcctaagcgagccgcttcctcttcttgtacccgctgaaggcagcccccaacaggggggctccctactcccacccaaccctgcccacactaagcccatagacttggggcctcccccggcacatcacccaggtctgccggacggcagaggtggatcgcggccttccactcctctgtcacggggccccggaactcgagagtaggccacaccgccccccagctgggcatggggcttcggcaggaaactgaacttgatcttgaggccccagaaaggcagcaactggagcagaagcaagacttcatctcttgctgacagcccaatttgtcaatagcgctttcctcagagccagccttaacctgctgttgagtccattaaaacgtttgcttaaagtttttaccaataattagatcatcagggttgtttagtgtgggatcaagccataacaaaactgcctagcctctcaggggcctagaatttacagaaccttcctcctccctgcagctagtctctcttctttattctgggggctgggaaggatcccaaaacagggaacttggccgaaccctgggctttggatgctaaccactgaagtaccagcacctgtaggatgctgtctttgaagaaactgaggcggacctccaaatgcagccctaaggcagaggtcaacgtggaagaccagcccttctccaagccccactggtctttgcaagctgtacgttgtaggcaatctgagaactggaaagggggactacaaccagaaagttggttaccctgccatgggaataaagtagctgttttccacccca

SEQ ID NO: 2010 - DNA, 1454 bp, Homo sapiens
cgcgcctgccggtgccagggtggggtaaggcccccgcccccacctccggaggtggcggccccacgcggccccaacaaactgccgttgtcccgcgggccgtgggcccggcacactggggctttgtccggccccccgccgcgacccgaggcgggggccccacatgaccgaaggggtaggaggagcctgcggcggcggcggtggcagcggcggctccaccaccatttccctcccgggccgggggtcggcgggcggtggcggtggctgggcagggctgggcagggccgcggacgccaggccccccgttccccgccaggctgcaggcgtcgggcctgggccgtcagggcagctgtgaccggatcgcttcccgggcggcgagctgggggtgcacccggaccgccgcccccgggatcatgggcaatggcatgaccaaggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtc

SEQ ID NO: 2011 - DNA, 1349 bp, Homo sapiens
caacaaactgccgttgtcccgcgggccgtgggcccggcacactggggctttgtccggccccccgccgcgacccgaggcgggggccccacatgaccgaaggggtaggaggagcctgcggcggcggcggtggcagcggcggctccaccaccatttccctcccgggccgggggtcggcgggcggtggcggtggctgggcagggctgggcagggccgcggacgccaggccccccgttccccgccaggctgcaggcgtcgggcctgggccgtcagggcagctgtgaccggatcgcttcccgggcggcgagctgggggtgcacccggaccgccgcccccgggatcatgggcaatggcatgaccaagatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtc

SEQ ID NO: 2012 - DNA, 1077 bp, Homo sapiens
ctttgtccggccccccgccgcgacccgaggcgggggccccacatgaccgaaggggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtc

SEQ ID NO: 2013 - DNA, 1212 bp, Homo sapiens
cctcggctctctccggggctgtttctccatcctgtcccgcctctgcctgtcattgcctttctgcctccccagccccagaatttccatccctgcaccctgcaagtctacctctctcctctcctctcctcctaagacctgccttcctcctctcccctctcatacccaagctggcctcccttggttccctcggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtc

SEQ ID NO: 2014 - DNA, 1256 bp, Homo sapiens
gccccggccgccgcggcccggcgctgaccagctcggtccgcccgcctctgaccttctgttctcgccggtctccgtgcggcggcatctccgtgtccctgtgactcgagaccgcggctgtcgggtctccccctctctgaccctgcgtctctgtccccgctgtgtccgccctctctccgtgactctgtgtgtctctcgctgtcttgctgtggctgtcactcccaggctgtctcccagtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtc

SEQ ID NO: 2015 - DNA, 1048 bp, Homo sapiens
acacgcggcttcctccaggcggatggtcaccggacccaaagtaccagatctgtctgtgcttcggtgaggaggacccgggccccacacagcaccccaaggagcagctcatcatggcggacgtgcaggtgcagcttcggcctgggagctcgtcctgcactctaagtgcctcaaccgagcgcccagatgggtcctcaacccctggcaaccccgatggcatcactcaccttcaatgcagctgcctccatcctaagcgagccgcttcctcttcttgtacccgctgaaggcagcccccaacaggggggctccctactcccacccaaccctgcccacactaagcccatagacttggggcctcccccggcacatcacccaggtctgccggacggcagaggtggatcgcggccttccactcctctgtcacggggccccggaactcgagagtaggccacaccgccccccagctgggcatggggcttcggcaggaaactgaacttgatcttgaggccccagaaaggcagcaactggagcagaagcaagacttcatctcttgctgacagcccaatttgtcaatagcgctttcctcagagccagccttaacctgctgttgagtccattaaaacgtttgcttaaagtttttaccaataattagatcatcagggttgtttagtgtgggatcaagccataacaaaactgcctagcctctcaggggcctagaatttacagaaccttcctcctccctgcagctagtctctcttctttattctgggggctgggaaggatcccaaaacagggaacttggccgaaccctgggctttggatgctaaccactgaagtaccagcacctgtaggatgctgtctttgaagaaactgaggcggacctccaaatgcagccctaaggcagaggtcaacgtggaagaccagcccttctccaagccccactggtctttgcaagctgtacgttgtaggcaatctgagaactggaaagggggactacaaccagaaagttggttaccctgccatgggaataaagtagctgttttccacccca

SEQ ID NO: 2016 - DNA, 1651 bp, Homo sapiens
ctgttctcgccggtctccgtgcggcggcatctccgtgtccctgtgactcgagaccgcggctgtcgggtctccccctctctgaccctgcgtctctgtccccgctgtgtccgccctctctccgtgactctgtgtgtctctcgctgtcttgctgtggctgtcactcccaggctgtctcccagtgagtcctgctctccgtctgcatgtgtccctctcccttgtcgctgactcctcggctctctccggggctgtttctccatcctgtcccgcctctgcctgtcattgcctttctgcctccccagccccagaatttccatccctgcaccctgcaagtctacctctctcctctcctctcctcctaagacctgccttcctcctctcccctctcatacccaagctggcctcccttggttccctcggttggttaactggccccctagcctaccctccccagagccccagacccctctcacagaggactcagggcccacaaaagggaagagagtgctccctgagccctgaggtccatacccttcatgggacagagaggggctgtgggccccccagctgccctgggggtggaagggggtgcagcccctgccccactgacccttgcctgtccttcctctaggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtc

SEQ ID NO: 2017 - DNA, 2963 bp, Homo sapiens
cccagaaactctgaggcggatcccccaacccagtgtcagactgatcgcctttggcccgagggcgaggagccacaggacagtatggccaaagcggcggcctcctcgtcgctggaggacttggacctgagcggagaggaggtccagcggctcacctccgccttccaggacccggagttccggcgaatgttctcccagtacgccgaggagctcaccgacccggagaaccggcggcgctacgaggcggagatcaccgcgctagagcgtgagcgcggggtggaagtgcggttcgtgcacccggagcccggccatgtgctgcgcaccagcctggacggggcgcggcgctgctttgtgaatgtctgcagcaacgcgttggtgggcgcgcccagcagccggcccggctccggtggcgaccggggcgcagctcctggcagccactggtccctgccctacagcctggcgcccggccgcgagtacgcggggcgcagcagcagccgctacatggtctacgacgtggtcttccatccagacgcgcttgcgctggcccggcggcacgagggcttccgccagatgctggacgccacggccctggaggccgtcgagaagcagttcggcgtgaagctggaccgcaggaatgccaagaccctgaaggccaagtataaggggaccccagaggctgcggtgctgcgcacgcccctgcccggggtcatccccgcaaggcctgacggggagccgaagggtcctctcccggacttcccctacccttaccagtacccggcagcccccgggccccgggcgccctcccctccggaagcggccttgcagcccgcccccaccgagcctcgctacagcgtggtgcagcgccaccacgtggacctccaggattaccgctgctccagggactcagccccgagccccgtgccccatgagctggtgatcaccatcgaactgccgctgttgcgctcggccgagcaggcggcgctggaggtaacgagaaagctgctgtgcctcgactcgaggaaacctgactaccggctgcggctctcgctcccgtacccagtggacgatggccgcggcaaggcacaattcaacaaggcccggcggcagctggtggttacgctgccagtggtgctgccggccgcgcgccgggagcccgctgtcgccgtcgccgccgccgcgccggaagagtccgcggaccggtccggaactgacggccaggcctgcgcttccgctcgcgagggggaggcgggacccgcgaggagtcgcgcggaggacggaggccacgatacctgcgtggctggggctgcgggctccggggtcaccaccctgggcgacccggaggtggcgcctccgccggccgcagctggagaggagcgtgtccccaagccgggggagcaggacttgagcaggcacgcggggtcaccgccgggcagcgtggaggagccatctcctggaggagaaaactcacctggtggcggaggctccccttgtttgtcctcccggagcctggcgtggggttcttctgcgggaagagagagtgcgcgcggagatagcagtgtggaaacacgcgaggagtcggagggcacgggcggccagcgctcagcctgcgccatgggtggtcccgggaccaagagcggggagcctttgtgtcctccgttactgtgtaatcaggacaaagaaaccttgactctgctcattcaggtgcctcggatccagccgcaaagtcttcaaggagatttgaatcccctctggtacaaattacgcttctccgcacaagacttagtttattccttctttttgcaatttgctccagagaataaattgagtaccacagaacctgtgattagcatttcttcaaacaatgcagtgatagaactggcaaaatctccagagagccatggacattggagagagtggtattatggtgtaaacaacgattctttggaggaaaggttatttgtcaatgaagaaaatgttaatgagtttcttgaagaggtcctgagctctccattcaaacagtctatgtccttgaccccaccattaattgaagttcttcaagttactgataataagattcaaattaatgcaaagttgcaagaatgtagtaactctgatcagctacaaggaaaggaggaaagagtaaatgaagaaagtcatctaactgaaaaggaatatatagaacattgtaacacccctacaactgattctgattcatctatagcagttaaagcactacaaatagatagctttggtttagttacatgctttcaacaagagtctcttgatgtttctcaaatgatacttggaaaatctcagcaacctgagtcaaaaatgcaatctgaatttataaaagaaaaaagtgctacttgttcaaatgaggaaaaagataacttaaacgagtcagtaataactgaagagaaagaaacagatggagatcacctatcttcattactgaacaaaactacggttcacaatatacctggattcgacagcataaaagaaaccaatatgcaggatggtagtgtgcaggtcattaaagatcatgtgaccaattgtgcattcagttttcagaattctttgctatatgatttggattaattctatataattttggacttttaaatattaaggttaaaaaatacctgtatctaaaattgattctgttaactgttgtcttaaaactaaaggtattaaagtataaaattaaaatttgcaattttttttaaaaaattgcaattttgattctcatgggggaaattggagataatttttttttttttgcctctggagtttaaagtttccttatggagataagttttgtgattcctgtaatagatgtgtatgttttctatttgagagttaaaacatttgagagttaaaacatttagttttaatacaacctatgtatatatacttctgtgttaaattttgctttgtcattaataaaatttaaaaatattcactaa

SEQ ID NO: 2018 - DNA, 2819 bp, Homo sapiens
cccagaaactctgaggcggatcccccaacccagtgtcagactgatcgcctttggcccgagggcgaggagccacaggacagtatggccaaagcggcggcctcctcgtcgctggaggacttggacctgagcggagaggaggtccagcggctcacctccgccttccaggacccggagttccggcgaatgttctcccagtacgccgaggagctcaccgacccggagaaccggcggcgctacgaggcggagatcaccgcgctagagcgtgagcgcggggtggaagtgcggttcgtgcacccggagcccggccatgtgctgcgcaccagcctggacggggcgcggcgctgctttgtgaatgtctgcagcaacgcgttggtgggcgcgcccagcagccggcccggctccggtggcgaccggggcgcagctcctggcagccactggtccctgccctacagcctggcgcccggccgcgagtacgcggggcgcagcagcagccgctacatggtctacgacgtggtcttccatccagacgcgcttgcgctggcccggcggcacgagggcttccgccagatgctggacgccacggccctggaggccgtcgagaagcagttcggcgtgaagctggaccgcaggaatgccaagaccctgaaggccaagtataaggggaccccagaggctgcggtgctgcgcacgcccctgcccggggtcatccccgcaaggcctgacggggagccgaagggtcctctcccggacttcccctacccttaccagtacccggcagcccccgggccccgggcgccctcccctccggaagcggccttgcagcccgcccccaccgagcctcgctacagcgtggtgcagcgccaccacgtggacctccaggattaccgctgctccagggactcagccccgagccccgtgccccatgagctggtgatcaccatcgaactgccgctgttgcgctcggccgagcaggcggcgctggaggtaacgagaaagctgctgtgcctcgactcgaggaaacctgactaccggctgcggctctcgctcccgtacccagtggacgatggccgcggcaaggcacaattcaacaaggcccggcggcagctggtggttacgctgccagtggtgctgccggccgcgcgccgggagcccgctgtcgccgtcgccgccgccgcgccggaagagtccgcggaccggtccggaactgacggccaggcctgcgcttccgctcgcgagggggaggcgggacccgcgaggagtcgcgcggaggacggaggccacgatacctgcgtggctggggctgcgggctccggggtcaccaccctgggcgacccggaggtggcgcctccgccggccgcagctggagaggagcgtgtccccaagccgggggagcaggacttgagcaggcacgcggggtcaccgccgggcagcgtggaggagccatctcctggaggagaaaactcacctggtggcggaggctccccttgtttgtcctcccggagcctggcgtggggttcttctgcgggaagagagagtgcgcgcggagatagcagtgtggaaacacgcgaggagtcggagggcacgggcggccagcgctcagcctgcgccatgggtggtcccgggaccaagagcggggagcctttgtgtcctccgttactgtgtaatcaggacaaagaaaccttgactctgctcattcaggtgcctcggatccagccgcaaagtcttcaaggagatttgaatcccctctggtacaaattacgcttctccgcacaagacttagtttattccttctttttgcaatttgctccagagaataaattgagtaccacagaacctgtgattagcatttcttcaaacaatgcagtgatagaactggcaaaatctccagagagccatggacattggagagagtggtattatggtgtaaacaacgattctttggagttgcaagaatgtagtaactctgatcagctacaaggaaaggaggaaagagtaaatgaagaaagtcatctaactgaaaaggaatatatagaacattgtaacacccctacaactgattctgattcatctatagcagttaaagcactacaaatagatagctttggtttagttacatgctttcaacaagagtctcttgatgtttctcaaatgatacttggaaaatctcagcaacctgagtcaaaaatgcaatctgaatttataaaagaaaaaagtgctacttgttcaaatgaggaaaaagataacttaaacgagtcagtaataactgaagagaaagaaacagatggagatcacctatcttcattactgaacaaaactacggttcacaatatacctggattcgacagcataaaagaaaccaatatgcaggatggtagtgtgcaggtcattaaagatcatgtgaccaattgtgcattcagttttcagaattctttgctatatgatttggattaattctatataattttggacttttaaatattaaggttaaaaaatacctgtatctaaaattgattctgttaactgttgtcttaaaactaaaggtattaaagtataaaattaaaatttgcaattttttttaaaaaattgcaattttgattctcatgggggaaattggagataatttttttttttttgcctctggagtttaaagtttccttatggagataagttttgtgattcctgtaatagatgtgtatgttttctatttgagagttaaaacatttgagagttaaaacatttagttttaatacaacctatgtatatatacttctgtgttaaattttgctttgtcattaataaaatttaaaaatattcactaa

SEQ ID NO: 2019 - DNA, 1504 bp, Homo sapiens
gggcaggacttccttgctggttgctaagacactcttgtttcgctccttgacaaccctggcgggggttcgctggctgcggccccggctccggcccccgcaggagcagcaccccccggggaaagacattttctgctcccaccgagttggcagggcctgcttcctgaatctcctgggtgtgtcttaactgccagtcccagcacctcctgaaagccccactctcctccagtggtcacagtggaaggatcatgggagaaacagaagggaagaaagatgaggctgattataagcgactgcagaccttccctctggtcaggcactcggacatgccagaggagatgcgcgtggagaccatggagctatgtgtcacagcctgtgagaaattctccaacaacaacgagagcgccgccaagatgatcaaagagacaatggacaagaagttcggctcctcctggcacgtggtgatcggcgagggctttgggtttgagatcacccacgaggtgaagaacctcctctacctgtacttcgggggcaccctggctgtgtgcgtctggaagtgctcctgacactctgtcccctgccccgtcccctgcagggccttttcctgccactcatctggggtggggagcagccctaggcaggtcctggtttttccaaggagagttggggtcttttctttttgtctttgtgtaccagtttcctgagccacgcccagtgtgtgaacttgacatctccatccccaggctctcaaccgtctccctcggagtctcagggtgtggacggggcagcgggcatgggtctgtgtgggagacgtggggtggggcggtgtgacagggtagaggaggtgggagatgagatcttccgcacaggaacacgccagtccccctttctccagggctgccttccccttgcatcctgggagccccactgccctgccatccccagtactgccgggaagtgtcggccgtccttgtcattagtggtcatatgaaaatggccccaagaaggagatgattctttcaagggacacaggcagcttctctccttgtcctctggggaggtgctgacccctcagaaaccccttcccccaacttgaccccaggctgaacagaccactgcatctcactgggccagcagcccccccagcccccagccttggtggggaccaagcagcctttcccgtcccctcctcgacccgtacagttgagagccaggggctggtgtgtgggagctgctacctggcagtttctcgaggggtcaccgagcctctggtgggacacctgggcaggagtgctctcaccacgaggctgcttccgcagggaaccctggcctgcccgcgacttcgcatcagggaccgcatgctgatttgtactgctctctgctgggttttctatgttcttttcgagtgtgggaaaagggttttagtagaagggtgaatcgtattttacacagcggtcttatttatataaatgtcttggtttttacaattaaaatgaccaaaaactga

SEQ ID NO: 2020 - DNA, 2504 bp, Homo sapiens
gtgcgctgaacgccccatatccgggttcccgccgcctccaccgccaccgcctcagccgcctcgcacatttagtcttgccgggagtggtgtgattcccgaccaagatggcggccgtggggcgagtcggctccttcggttcttctccgccgggattatcctcgacttacactggcggccccttgggcaacgagatagcgtcgggcaacggtggcgccgcggcaggcgacgacgaggacgggcagaacctttggtcctgcatcctcagcgaggtctccacccgctcgcgctccaagctccctgcggggaagaacgtgctactgctgggtgaagatggagctggaaaaacaagcttaataagaaaaattcagggaatagaggagtataagaaaggaagaggattggaatatttgtacttaaatgtgcatgatgaagacagggatgatcaaacaagatgtaatgtttggatcttagatggagacctatatcacaaaggcctccttaaattttcactggatgccgtatctctgaaggatactctagttatgctggttgttgacatgtcaaagccttggactgctttggattctttacagaaatgggcaagtgttgttagagaacatgttgacaaactgaaaatccctcctgaagaaatgaaacaaatggaacaaaagttgattagagacttccaagaatatgtagagccaggagaagacttcccggcttctccccagagaagaaatactgcgtcacaagaagacaaagatgacagtgtagttttacctctgggtgcggatacacttacacataacttgggcattccagtactagtagtttgcacaaagtgtgatgccattagtgtattggagaaagaacatgactacagagatgaacattttgattttattcagtcacatatccggaagttttgtttacagtatggtgcagcacttatttacacttcagtaaaagaaaacaaaaatatagacttagtatataaatacatcgttcagaaactatatggatttccctataagattcctgctgttgttgtggaaaaggatgcagtatttattccagcagggtgggataatgataagaaaataggaatattacatgaaaattttcaaacattaaaagcagaagataattttgaagacatcataactaaaccacctgttcgaaagtttgtacatgagaaggaaattatggcagaagatgatcaggtgtttcttatgaagctacagtcccttttagcaaagcaaccaccaactgcagctggaaggcctgtggatgcctcaccaagagtcccaggaggctccccacgaacaccaaatagatctgtatcatctaatgttgccagcgtgtcacccattcctgctgggtcaaaaaaaattgatccaaacatgaaagctggagctacaagtgaaggcgttctggcaaatttcttcaacagtttgttgagtaaaaagactggctctccaggaggccctggtgtgagtggtggtagccctgcaggtggggctggaggtggaagcagtggtttaccaccatccaccaaaaagtcaggccagaagcctgtcttagatgttcatgcagaactagacagaattacacgaaaaccagttacagtttctcccacaacacctacatctcctacggaaggagaagcttcttgaagataccaaataaagccatttattctgttttctgggataatgtaaacatgcctctgccttttccttcaaaagtggaattagaaagctggagtgcttcttcagatggactaaatttatgtcgtgtgtgtgtgtgtgtgtgtgtgtggttacccattttttagaaggagccgtacagaagaaaaattattctacattatgtaggattgctgtttgcattgccattttgcataagaaagtaatttttgattttgaaaatctcaaaacttttagatctgaaatacagccatgtgatcgatcatattctaaaggctatttaaaacatgtaaaaggatttggggaacggcagaaaacatgcagtttgggcatttgactgacttggaagtctaagcttattttagttataactattaaaatcatttttaaaaatttgttagttttgctgacagagaaaaatcgtcagttgtcagattttgcacaccacaataaatgtaccaccacacacggaatatgctaagaaaactatcagatagcgtttgatacactagtcattgtctcaatcactgatcctgtaagttgtcatcaaaatatgatttagaaatattggccaaggtgttgctttaactgaggagaaaagaaagcacactgcctaaatgtgtaaaagaaaaatgcagaggttattaaaatgtaaagaagtaacaatctttggatttgtctatacatatatatatatatatatggctttgccttaatatacccccttttttgtttgtgactttcaactgtaatcagttaataaagtatttattctctgcattcaggttcaaataa

SEQ ID NO: 2021 - DNA, 2217 bp, Homo sapiens
caaaggcggggattgcgtagggaaaggccctaggccataaacgggggtggggcctccccggaggccagtgcgcggccgcggtgctctaccggcgtgtcgctccgccccagggagagccggcgctaccatggaggagtaccatcgccactgcgacgaggttggcttcaatgctgaggaagcccacaatattgtcaaagagtgtgtagatggggttttaggtggtgaagattataatcacaacaacatcaaccagtggactgcaagcatagtggaacaatccttaacacacctggttaagttgggaaaagcctataaatatattgtgacctgtgcagtggtccagaagagcgcatatggctttcacacagccagctcctgtttttgggataccacatctgatggaacctgtaccgtaagatgggagaaccggaccatgaactgtattgtcaacgtttttgccattgctattgttctttaactgactaaaaatgttgggctaaagccattaacttaagaatttgtcagtgtatcctttccaaaaagagtaatagttgtttactagtgtgctagatgaaaagcgtgcaatatgctttaaagctatcaacaaaaactgaatattataagcaagcaatatcatagtaattggcagattagctcatattctatacagcatcgtttaaataggaaaaatttaatgctagcaaaaaataaatttagaaatatggcatgacatgaaaatacaatcttatatttacaccagcttttcactaatattttgtacctaaggtgatggggaactccattcagataataaaattctctttcagctagagaagttaacaggaataaatatatgaacaaaaaagctgcaaggataaatgtggagaaaatgatgagaattagctaacatttttaagtttttttaaactttcttcccctcagttgtacttaatatttagtggaaagtaataatttttttaattttctatcaactaatagtatagtaacaactatgattaacttgtttactttttctgaggattagtaaatcaattttttttaatttcaaatttttggatttacacttgagggtaaattaaatctggtaaactgaatttcctagttaaataaaattagttgcagtatatgatgaacagtgtatgactcaaacagctgccttacaattcactcattccatgtggaacaaacatttatcagatgcctattatgggcatatgtctctgctaagcaccatagttgtcaatgtgctgtgcaaatgctaagttccttttagcaattgttcagttggaagacgtattaatatttggggaaggaaaagaaagtagttgttttacaagggaggaaaaaagtgaatctggttacacatatggaagtaagcaaaatgaaaagcacttattgctttctgacagaattatagatgtaattttaagagttgctcctagcaagttaaaagtgcatataaaatatgcaactcttagttaaaggccttattatcagtcttacctatacaagtagtaaattttgtcattgctttagttacaaccatctgtaaataacttaaaagacttattatgtggggttcaaattgagtggaataaagtatagattaaaagtatacaatccttagcacgttatctcagggcttatgaaatgtaattaaatttattaagaaaatagatgaaaaattagggtacacagctggccaccaaatgcgaagtcaatctgctacttaaccctgaaaacaaaatcagttttgcatattaccactaacactaatacatatagagagcggaaccataactcattgaattttggagaggaataagcttagcgttaatattgacaatattaaggcaatattcttgtaggaatactatgtgcatgtttgatattttgccaaataacaataattaataattgttcaatgtttaagaataatattaacaaaataaaggagtttaatgcagtgatctttgtttttggcacatcaaaaattctcagtcattattcatgtttctttatgctgctggcttttgtgccctggaagatcataatagtgaccaaaatatacatgcagacttgttttttattattgttgtttaagcataatttaagaaaaaaaatttttacctggtgaacttgctatctgctctgtttctagttaaaatataataaatattatcttcctgtgctgta

SEQ ID NO: 2022 - DNA, 920 bp, Homo sapiens
taccatggaggagtaccatcgccactgcgacgaggttggcttcaatgctgaggaagcccacaatattgtcaaagagtgtgtagatggggttttaggtggtgaagattataatcacaacaacatcaaccagtggactgcaagcatagtggaacaatccttaacacacctggttaagttgggaaaagcctataaatatattgtgacctgtgcagtggtccagaagagcgcatatggctttcacacagccagctcctgtttttgggataccacatctgatggaacctgtaccgtaagatgggagaaccggaccatgaactgtggagtcttgctctgtcgcccaggctggagtgcagtgatgcaatttcggctcactgcaacctctgcctcccaggttcaagtgattcttctgcctcagcctcccgagtacctggaactacaggcacacgccataacgcctggctaatttttatatttttagtagagatggggttttgccatgttggccaggatggtctcgaactcctgacctcaagtgatccacccacctcggcctctcaaaatgctgggattacaagcgcgagccaccctgcccggccgaaaagatctcaaacattcatctcttacaagatttagatgactatcatcaatatgccttaacatcagtagtttaggagactctagcccactttgtctagttgcaaactgtaattctccctgtggtcccactgaatatcattccacagcattcttggatatatatgatgtattgacaattcaggtctagatagaaatggcccctattgcttcatgaagaatatcctttccccaaatgtcttctgaggagctcaagattaaagctagtatcctgtacagacacttgcaggactgctagtatgatatatattgaccctatgggagac

SEQ ID NO: 2023 - DNA, 719 bp, Homo sapiens
ctcccagcgagggcggtcccaagagttggggtgcggcgtcctccgagcccgggtcctctcccctgggcccgggatccgccccgcccgacccgttctccccaccccaaagtcctgagattcggggtgggaggggtggccaggagcgcgcggatcagacggtggggtcggggcagggttgggaggacgaggcctgacttgggtgcgaggagtgggcatggggtgacgggcgccgccctcctaccgggcgggcctcgaaaacgggtcttcccgctgctgcctccgtcccttggcttcctcagcgcgggtgctgcagcccccatggctcggagtctcggggtcctggtggcactgccattcccgctcccggttggcttcaatgctgaggaagcccacaatattgtcaaagagtgtgtagatggggttttaggtggtgaagattataatcacaacaacatcaaccagtggactgcaagcatagtggaacaatccttaacacacctggttaagttgggaaaagcctataaatatattgtgacctgtgcagtggtccagaagagcgcatatggctttcacacagccagctcctgtttttgggataccacatctgatggaacctgtaccgtaagatgggagaaccggaccatgaactgtattgtcaacgtttttgccattgctattgttctttaactgactaaaaatgttgggctaaagccattaac

SEQ ID NO: 2024 - DNA, 2051 bp, Homo sapiens
ttgcctttttgttcccctgtcctcattcctctgctgcaaaaccttctgcttaaaatactggttcatttctagttacagggacccacttgccatctgtcattccaggaaatttgtgaaatggatccagataaacaagatgctcttaatagtattgagaattccatttatagaacagccttcaaattacaatcagtgcaaactctgtgccagttggacttgattgacagctccctgattcagcaggtcctactgcgtccaagtttctgggaagctcgcaagcactccctttctgtgcagcaactttctcaggcactccaagagctgtttcagaaggccagggaggaaaacccaggacaagtgcatcccagagctccggaactcactctgagccttctcacgacaatgtacaacagcaaaggaacaggttttctccagcttatgcctgcggccgctgccctaataaccctctcaggagacagccctctttcaaaataccgagctctttttcaactctatgcagaaaatagcaggggaggctatgattctgggccacgcatgactcgaagggttttgagaaaactactaacagatctacagcagatcccaactttcgtgggagagagtcgtgctctgtgccctgtggaaagtgccacccgcagctgtttccaaggggtgttgagcccagcaatcaaagaagaaaaattcctgtcttgggtccaatctgagcctcccatcctcctgtggctcccgacctgccaccggttatcagctgctgaaagggtcactcaccctgctcggtgcactctctgcaggactttcccaatcacgggactcagataccgctgtctgaagtgtctcaactttgacatctgccagatgtgtttcttatctggtcttcacagcaagtcccatcagaagtctcatcctgtcattgagcactgcattcagatgtcagcaatgcagaatacaaaacttctcttcaggaccctcagaaacaaccttcttcaggggcgctgtaggaagaaagaagcagcgagaaggcagcagctgctggaccaggtgaatccaaagggtgtgcctcaccatgcgcaggccaggctccttaaaaaacagttaaaccaatacaaagacaagttgcaagctatatacacctcccaggaagaaagaatttgtcgatttgaaacaaggattcacaaactcaaaaccaaccaggatagtctatggaccaagctacaacagataagacgggacctacaggcaaggttgcagccacccggtccttcatcttcttcctttcaaaatgtggggaacaaggttgaccattcttcaactgaaaaggttccaaagggaggggattatttgcagatcaagaatgccactgaagatgcttcaacaggggaacctcttcctaagcttgatgaggttgacagaagtcacagaagtcacacaaatgcagagcatgctctgcgaaatccagaatcaccagagaccactttgcacagcaccagggcacaaagccaaacacaaaagatgccacagaaagtcattagtgccctacccagttatcaggagggactgaagcaggacatccccaaaatggttcctgctgaaatgagcagtcctgctctggcagccgtggaaaagaaagaggcaggtaacatcaaggagagaaaggatgagctggaggaagaggaactgcaagaactattgtcaaaacttatggatgccttcaatctagaaacgccatcaggcccggagtcttcagtaaacatggacctgtacagtggagctcagcgagtgtgcagggccttctctgcccttgttgatcaaattgccttgcccaatttgaagtgaaatggagtccaggctcaaaggcctcttggtgtgatgacaaaatgcagttgcacaactgtattaaaagaattaagacttctacctttcttttaatagtttagtgtgaactatgaagaaaacaggttttgttttttgatctccctccctacttatgtatcttagttctgcagttcagagtgaaggttgggggttagcag

SEQ ID NO: 2025 - DNA, 1321 bp, Homo sapiens
gggcgctttagggactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgaccaagaaaaaaaagaagaaacaacacaagattccaacaaatgacgaattactgtatgatcctgaaaaagataacagagatcaggcctgggttgatgcacagagaaggggttaccatggtttgggaccacagagatcacgtcaacaacagcctgttccaaatagtgatgctgtcttgaattgtcctgcctgcatgaccacactttgccttgattgccaaaggcatgaatcatacaaaactcaatatagagcaatgtttgtaatgaattgttctattaacaaagaggaggttctaagatataaagcctcagagaacaggaagaaaaggcgggtccataagaagatgaggtctaaccgggaagatgctgccgagaaggcagagacagatgtggaagaaatctatcacccagtcatgtgcactgaatgttccactgaagtggcagtctacgacaaggatgaagtctttcattttttcaatgttttagcaagccattcctaaacagcccaactggcatttaattacccaatactgtatataaggcaaatatggacagttactttcctcttgcctgttcatatccttcagtgacattgaggaagcagtgtttctctttttaaaggagaatagttgtcaaccttcattcatctcttacatctctcaccctctccttttttttttctttgattttcccccttattgatgggactgatattcattctgtttttgatgaacatttggaaactgtcgggctttttattaaagctctgtagaattaaaatgttctggaattataagcaatctttgtttctgagtgttatttttattttggatatagctttgatgtaattaaactggaaactctttcctgaattgtctgta

SEQ ID NO: 2026 - DNA, 9875 bp, Homo sapiens
atctgtcagttacgggggctgcccggcgggcgggctggaggcgctcgcaggctgcctagtcgttcgctcgctctctctcgcgtgctccctctcgccgcctgtggggaagtcggggccgcccgagcggccgtcgccaccgcctcgccccgacctccttcccggtcccctcccggcccagtccctcccgcccgcgcaccccgagtagtgagtggccccgcgcagggtctggagagtcaccgcggcggcgccgggtggtggttaaaccatgttaaggaggattttacagaggactcctgggagagttggctctcaaggttctgatttagattcatcagcaactcctataaacacagtggacgtcaataatgaaagctcttcagagggtttcatatgtccccagtgtatgaaatctcttggatctgctgatgaacttttcaaacattatgaagctgttcatgatgctggtaatgactcaggtcatggaggagagtctaatcttgctttgaagcgagatgatgtaacactgctcagacaagaggtccaagacctacaggcttcacttaaggaagaaaaatggtactcggaagaattaaagaaggaattagaaaaatatcaagggctgcagcagcaagaggccaaacctgatgggttggtgactgattcatcagcagaactacagtctttggaacagcaattagaagaagcccaaacagaaaattttaatattaagcaaatgaaagacttatttgaacagaaagcagcccaacttgctactgaaattgcagatataaagtcaaagtatgatgaagaaaggagtcttcgagaagctgctgaacaaaaagtgacacgtctgacagaagaattaaacaaagaggcaactgtaattcaagatctgaagacggaactgcttcagagacctggtatagaagatgttgccgtgctaaagaaagaactggtccaagttcaaacactaatggataacatgaccttggaacgtgagcgagaatctgaaaaactcaaagatgaatgcaaaaaattgcagtcacaatatgctagctcagaggccacaataagccagctaaggagtgaacttgccaaaggcccccaggaagttgctgtatatgtacaggaactacaaaaactgaaaagttcagttaatgaattaacacaaaaaaatcagaccttgacagaaaacttgctgaaaaaagaacaagactatactaagttagaggagaaacataatgaagaatctgtgagtaaaaagaatattcaggcaacccttcatcaaaaagacctagattgtcaacagcttcagtcaagattgtctgcatctgaaacctcactgcatagaatacatgtagaactaagtgaaaaaggagaagctactcaaaagctcaaagaagaattatctgaggtagagaccaagtaccagcatctaaaggcggagtttaagcagctacaacaacagagagaagaaaaggagcagcatgggttacaactccaaagtgaaattaatcaattacatagcaaacttctggagacagagcgccaactaggggaagctcatggtaggctgaaggaacagagacagctttcaagtgaaaagttgatggataaagaacaacaagtggctgatttacaactcaaactttctcggttagaagagcagttgaaggaaaaagttacaaattctacagaattgcagcatcaattagataaaacaaagcaacagcatcaagaacaacaggctcttcagcaaagcaccacggcaaaacttcgagaagctcagaatgatttggaacaagttctacgtcaaattggcgataaggaccaaaagatccagaaccttgaagctttattacagaagagtaaagaaaatatttcattactagaaaaagaaagagaagatctttatgcaaaaattcaggctggtgaaggagagactgctgttcttaaccagttacaagaaaaaaaccatacactacaggagcaagtaactcaactaacagagaagctgaagaatcagtcagaaagtcataaacaagcccaggagaatttgcatgaccaggtacaagagcagaaggcacatcttagagctgcacaagaccgtgtcctttccctagaaactagtgtcaatgaattaaatagtcaattaaatgaaagcaaggagaaggtctcccagcttgacatacagattaaagccaaaaccgaactattactatcagcagaagcagcaaaaactgctcaaagagctgatcttcagaatcatttggacacagctcaaaatgcattacaagataaacagcaggagttaaataagattactactcagttggatcaggtcactgcaaagttacaagacaagcaagaacattgcagtcagctggaaagtcatcttaaagaatataaagagaaatacctctctttagaacagaaaaccgaagagctagaaggtcaaattaagaaactagaagctgatagtcttgaagttaaagcaagcaaggagcaggctttgcaagatctacaacagcaaagacagctgaacacagatttagagctcagagccacagaattgagtaaacaacttgaaatggagaaggaaatagtatccagtacaagattggatctacagaaaaaatctgaagcccttgaaagtatcaagcaaaagcttaccaagcaagaggaagaaaaaaaaatcctgaaacaagattttgaaactttaagtcaagaaacaaagattcagcatgaggaattgaataacagaattcaaacaacagtaacagaactacaaaaagtgaaaatggagaaagaagctttaatgacagagctttctacagtaaaggacaaactatcaaaagtttctgattctttgaaaaactctaaaagtgaatttgaaaaggagaatcagaaaggaaaagccgctatattagacttggaaaaaacttgcaaagaattaaagcatcaacttcaagtgcagatggaaaacacacttaaggaacagaaggaactgaaaaagtcacttgaaaaagagaaggaggcttctcatcagttgaaattggaactcaattcaatgcaggaacaacttatacaggcccagaatactttaaaacaaaatgaaaaagaagagcaacaacttcaggggaacataaatgagctaaagcaatcaagtgaacagaagaaaaaacaaattgaagcactccaaggagagcttaaaattgctgttttacagaagacagagcttgagaataaactacagcagcagttaacacaggcagcccaggaacttgcagcagagaaagagaaaatatcagtattacaaaacaactatgaaaaaagtcaggaaactttcaaacagcttcaatctgatttctatgggagggaatctgaacttctagccaccaggcaagatcttaagtctgtagaagagaagctttctctagcacaggaggacttgatttcaaacagaaatcaaattggaaatcaaaataaattgattcaagaactgaagactgccaaggctacattggagcaggattcagcaaagaaagaacagcaattgcaggagcgatgtaaagcactacaagacattcagaaagaaaagtcactgaaagaaaaagaactggtaaatgagaagtctaaattggcagagatagaagaaattaaatgtagacaagaaaaagaaatcactaaactaaacgaagaactcaagtcccacaaactagaaagcataaaggagataacaaatcttaaagatgctaaacagcttctaattcagcagaaattagaacttcaaggaaaagcggactccctgaaggcagctgttgaacaggagaagagaaatcagcagatactaaaagaccaggtgaaaaaggaagaagaggagctgaagaaagaatttattgagaaagaagctaagttgcattccgaaataaaagaaaaggaagtaggaatgaagaagcatgaagaaaatgaggctaaacttaccatgcagattacagcattaaatgaaaacttaggcactgtgaagaaggagtggcaatctagtcaacggagagttagtgagcttgagaaacaaacggatgacttacggggtgaaattgcagtattagaagcaacggttcagaataatcaagatgaaaggagagcactactggaaagatgtcttaaaggagaaggtgaaatagaaaagcttcaaaccaaagtattagaattgcaaagaaagctggataatacaactgcagcagtgcaggagctgggcagagaaaaccaatcacttcagatcaaacatacacaagcgttgaatagaaagtgggccgaagacaatgaagtacaaaactgtatggcctgtgggaaaggcttttcagtaacagtgagacggcatcactgccgacagtgtggaaatatcttctgtgctgaatgttcagccaaaaatgccttaactccttcctccaagaagcctgttcgtgtctgtgatgcatgtttcaatgacttgcaaggataatgggttatcacaacttcagagtaatattacactaacattagatttttaataaatgtacttaatagaggtcttggactactatttggtttggacactggttgcaatactagaccaaataggaattagtatattttggaatgttatggatatcaagtaaaactcttctatttttgtgagacttgggcttatcatctttcattacttttttcccatttagcccctggaatagctttcatgccaagtttagaattagccaatgaaatgtaaataaactttggacagaaaatagcaatgtatttttttaatataatttcattattcacaaatgaagaatgcaattccatagcttacttctttctcctaaatttaatgtacaaaaatgtacatggatgatattatcacttgttgctgtttttgttgcacaatagcacattaattatattaaatattctctttgtgaagttatgcacagaactgtaacactttcctctgcctttttctcttatatgtgggttcatggttcagttgcattgttatgttatgaatttactacttgggtgttctaaatacagtttatcttaaaatatgtagtaatatgaattcaaaaatggtttttgttttaacaatattaattaaattttcttgggtggattttataaaaacctctgtaaaatcaatttgtttacttatagttatctggggttgtattgcaaagaatagggttaatttttctttttgtctttttctgtctctttcttaaactcccacgcattgtccatttagaatcttagaaagcttcttaccctcgctgtcagttggaggatgaataataaacattgtataatgttcttattctcggtttcttgtaagtgggaagtcttttgagatcagccttcatatcatacccttattttgtctctctagcatcttcaggaacctgagtttgctttttacatagatctgattttttcctttatttggtttaacattttcaagcatagatcagcttcatgtatttgttttataattttgcatcttaaagctagtaactaatattgctgtggtcttattggtgaaaacaaaatataaaatgataagaagacattaaatattttactttctatttcttaccctattgggaagaatttttaaaagttgtaaaattgacttaaagttaaaatggttctgaatttggtgttccatgtcaactgttcccagttttaattttaactttgcaaaaataatgttgtgaaattccctttaagtaactaacacctagaaatagagtatcaccaaaaacaaatgtatttaggaatcccagttacaataaaaactgaaacagcatggctaagcatcttaaggataattaagaaattagcttatttgtatgctgaacaatggaatcgaactttaatttagcatagtcttattaatttggaaaattgtaaaacatctcaagagagaagttattaatattggtttattaatctttctagagaagaagtgtagttatacattcattcagtgcaatcattttataacagtagttaatatttcatttataatagttcttaatatacatttgctttcaaatattctgaaatgaaattatattcatgctatacctacagtgtatgtaaactaaagagatcactacatatttgtttaattatttaaaaaaaaatttaagtaaaccctgttgtcattagctattaagaacattgattaagtccctggacttggataaacatatatccttgaacatatataatgaagaaatacagtggctctttattaaaaataatagttggataatataaactgaactatttatgcatttttatatacttataaatccttccaaatagttttaattctatccttttacatataaataacttaataagtgtgctggaaaaacacagatattcacagcaccactgttttttttttttttttgagataataaattccatgagaaatctgggtttgaatatttgtttactttgtctcctaattgaacaccactccaggccttctgtctgtctcccctttacccccaaaatactcacaaaaaaattttaagacaacaagtaaccatatataggtgtttgaatgattttctcatttttatctaatttcatttcataagtcccgagtaatttacctaccataggctactatactgataatataaatgaaaccgaacattttttgctactaactctccccaatttaatgtgttttcgaaataaaaatttaaatttttttccttttaattaaaaagtcatctttgaagtccttattggctgtacattttacatgtttgctggtactattattttgtcagtcagttaaagctggcatgtacagctcttggctttaatgaaaagcacattgacataatgttagtaaattccaaaccccggcacagaatgtgagttaaaattaagtcttgctgggttagtgtacaataaactatacctacagacttttttttaatagaaagaagacaaagctgctggtataggatttgttcctttgaagaaaaaatgagggaaacaaacacaaaaacctcaatgcagtgtataaataacattttgttcaactacctcttaatgtggaattatctactttaatagtttcctgacagtaatgttaaatagtaactgccaaatttgttattttcccatctctcttaaaaaagtctttatgattattttatatagttttgagaactttaaagccacttttttttaaccttacatttgcataaaaatgtttagcttttaagtagagagcaaattatgatcatatattttgatattcatgacctgtttgactataggagtttttttaaaaaaatgcactttggctataaaaccatggatgatttgatccataagatttaaatgtgccaccattatagtattcctagacatgagcttgatgaatggtattctgtaattataacgtgccacacattattgtgtcttaattgcccttagcctgaattttaatgatcaatttgttattgttgcagatgtgaatattgtgcataaacttactaaatttatgtaaaattgtataaaatagaattagaagtcactaagttctttctgtgtagaagtaataaatttattgtaacacaatgcagttgtgtatatgacattctgtaattccttgaactggatcatatattcataagttctgtagatacttatgcatgaacattttctcatttagtttttgggttcattatttgtattgtgtttactacttgtgatcatgtagttgtgccttactttgtgagaaaggttagctcagtaaatactgcaatttctaaactcagtgattggaaggttattaattataaatgtaactgataaagtacgtgacagcatttaaatctgtataaagaacaatggaaggatccttattgaattgttgcttttttttaatatgtttaaatattatattaaaaacatttctttctaaactagttgtattctgtgactataaattgttttgtctaacaaaagagagaacactgtattaaccattttgcattaatttatttacagaatattaggactttgcacttggatatagacagtggtgttttaatgttgttcaatttcgaatagtaattaaattcctgatctcaagagaaattattaatgccattttgccttagacattccatttaatattgtagagaattaacaaaactaaaaacaaatataaaaaatatgtaattaaccccttatttcattgtgtgtctgcatttaatacccagatgaccatttaaagatacttaaaacattatttatttatttatttatttatttttctccctcccctccccaaagatactttttggaaggcccaatgtgccattgttttttgctattttttcttcctgggagccacggttctagaatggtttttgttctgacccccgtgatcccttcattcgaatgtgcttcattctaaaccctccaaagagtttaatgtgcatatcctcaaacatctaatatattgtatattagacatgttactttgtgagctttatagaattccagtttatgtacagcatattcttgagctgttttatatattttgttaatttagtcagtctgtctctccctttaatgagattcagagggagaaaactacctttatacatgtaagtctgtggttgctggattcatgggactaaaggaatttgagaggccacctcatcctagtccactgctcacctccgaggttagtttatatctaaacatttgcaagatgattgttaatgtaaaaattttttttaaccagaaatttctttataaaatcttctcttgcataatctatattgtattctcctggacataactgctttcagtcccatccagatgccatctctaggaattcacttgaagcttgaagtctattctcccctttttctcccctccacctcatttattcttagctattaacaatagttactgtcctccagattttcctttttttcttctattaaatttctgacattattataaagaggttattagtctccattctaatagtgcttgccttgtacaaaagcctttctgctgcacttgtctttactgctttgtttgcatagtgaaatttcaccttcctcaaggaattactgggcacatgacttgcccaaacattatcctctctaccccattcttcagcttaacaaaatcagctaaggcttcagttgtcttgcagccaaatttgataaatttactactttcactttgcaaattgcaaaaggtacgattctgaaatggaagtttgtggacttccctttgatgcaataatctgaccctaagaactagttccttgaatgtagttaatagtatatatcctgccatgataataattattcaaactgcctttcatgataaaaattctgaagaaatttgaagtcctgccaaataaaattaagtgactgtactgtgctaacacacacacacacacacacacacaccaatcaaaaccagaaagtatttttatggcaaacaccatcattcttcaaaaaataaagttaagagacagataccttactatgtctatgaaaatctgtacacttcacaacaggccaagaaaagccatgcaaaagtgttaactggtgaaagccagattttttttttcttcctatcttaaagtaatggaatttagtctttgggattttctacttccacgttagagtactatatacctgagatgagtttgagaataggaattttaaaactgctacttaaatgtagtccctatttattgctttgtatattaaaagaacaatcaagctttgtatctaaagatttatcattatgtttgaggtaggact

SEQ ID NO: 2027 - DNA, 930 bp, Homo sapiens
ctgaggcgggtggatcatgagactcctgggagagttggctctcaaggttctgatttagattcatcagcaactcctataaacacagtggacgtcaataatgaaagctcttcagagggtttcatatgtccccagtgtatgaaatctcttggatctgctgatgaacttttcaaacattatgaagctgttcatgatgctggtaatgactcaggtcatggaggagagtctaatcttgctttgaagcgagatgatgtaacactgctcagacaagaggtccaagacctacaggcttcacttaaggaagaaaaatggtactcggaagaattaaagaaggaattagaaaaatatcaagggctgcagcagcaagaggccaaacctgatgggttggtgactgattcatcagcagaactacagtctttggaacagcaattagaagaagcccaaacagaaaattttaatattaagcaaatgaaagacttatttgaacagaaagcagcccaacttgctactgaaattgcagatataaagtcaaagtatgatgaagaaaggagtcttcgagaagctgctgaacaaaaagtgacacgtctgacagaagaattaaacaaagaggcaactgtaattcaagatctgaagacggaactgcttcagagacctggtatagaagatgttgccgtgctaaagaaagaactggtccaagttcaaacactaatggataacatgaccttggaacgtgagcgagaatctgaaaaactcaaagatgaatgcaaaaaattgcagtcacaatatgctagctcagaggccacaataagccagctaaggagtgaacttgccaaaggcccccaggaagttgctgtatatgtacaggaactacaaaaactgaaaagttcagttaatgaattaacacaaaaaaatcagaaaaaaaaaaaaaaaaaa

SEQ ID NO: 2028 - DNA, 2097 bp, Homo sapiens
gcaggcggtgacgtgttgccggcgggggccgggcgggggtgcggctccaggaaaggagcgcggcctccaggaagccggctggccgtgatgctgcccactggtggtcccccgctcccggggtccccggccggccaagcaggagggctctaactccgtgaggaccccagcattatttctataattgtttgtgagaaggactgaatcccagagcattgccttgttgctgacctttcagtatggggaggattggcatctcctgtctttttcctgcttcttggcattttagcatatctccagtagggtgtcctcgaattctgaataccaatttacgccaaattatggtcattagtgtcctggctgctgctgtttcacttttatatttttctgttgtcataatccgaaataagtatgggcgactaaccagagacaagaaatttcaaaggtacctggcacgagttaccgacattgaagctacagacaccaataaccccaatgtgaactatgggatcgtggtggactgtggtagcagtgggtctcgagtatttgtttactgctggccaaggcataatggcaatccacatgatctgttggatatcaggcaaatgagggataaaaaccgaaagccagtggtcatgaagataaaaccgggcatttcagaatttgctacctctccagagaaagtcagtgattacatttctccacttttgaactttgctgcagagcatgtgccacgggcaaaacacaaagagacacctctctacattctctgcacggctggaatgagaatcctccccgaaagccagcagaaagctattctggaagaccttctgaccgatatccccgtgcactttgactttctgttttctgactctcatgcagaagtaatttctgggaaacaagaaggtgtgtatgcttggattggcattaattttgtccttggacgatttgagcatattgaagatgatgatgaggccgttgtggaagttaacattcctggaagtgaaagcagcgaagccattgtccgtaaaaggacagcgggcattctcgacatgggcggcgtgtcgactcagatagcgtacgaagtccccaaaactgaagaagtagctaaaaacttgttagctgaatttaacttgggatgtgatgttcaccaaactgagcatgtgtatcgagtctatgtggccacgtttcttgggtttggtggcaatgctgctcgacagagatacgaagacagaatatttgccaacaccattcaaaagaacaggctcctgggtaaacagactggtctgactcctgatatgccgtacttggacccctgcctacccctagacattaaagatgaaatccagcaaaatggacaaaccatatacctacgagggactggagactttgacctgtgtcgagagactatccagcctttcatgaataaaacaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggattattgtgcaacaaagtggtccattttgcgggaacgctttgaccgaggactgtacgcctctcatgctgacctccacaggcttaagtatcagtgcttcaaatcggcctggatgtttgaggtgtttcataggggcttttcgtttcctgtcaactataaaagcttaaagactgccttgcaagtttacgacaaggaggttcagtggacccttggagccatcctctacaggacccgctttctaccattaaggaaaatagggatgctgataataccttgctcagggggttgtccaaagctgtgttgtgcagtatggcagccaccaccatatggggccaccaaacacttgcaatgtgctgcttggaattgagatgcgctgcaaacgcaaagtacgtgctggatttcaaagacttagtacaaaaagaaaaaagaacgcaaaacatctcattaataatttttgtattgattccatattgaaatatattgcatcaaataaaatatatctttaacattga

SEQ ID NO: 2029 - DNA, 5861 bp, Homo sapiens
gcaggcggtgacgtgttgccggcgggggccgggcgggggtgcggctccaggaaaggagcgcggcctccaggaagccggctggccgtgatgctgcccactggtggtcccccgctcccggggtccccggccggccaagcaggagggctctaactccgtgaggaccccagcattatttctataattgtttgtgagaaggactgaatcccagagcattgccttgttgctgacctttcagtatggggaggattggcatctcctgtctttttcctgcttcttggcattttagcatatctccagtagggtgtcctcgaattctgaataccaatttacgccaaattatggtcattagtgtcctggctgctgctgtttcacttttatatttttctgttgtcataatccgaaataagtatgggcgactaaccagagacaagaaatttcaaaggtacctggcacgagttaccgacattgaagctacagacaccaataaccccaatgtgaactatgggatcgtggtggactgtggtagcagtgggtctcgagtatttgtttactgctggccaaggcataatggcaatccacatgatctgttggatatcaggcaaatgagggataaaaaccgaaagccagtggtcatgaagataaaaccgggcatttcagaatttgctacctctccagagaaagtcagtgattacatttctccacttttgaactttgctgcagagcatgtgccacgggcaaaacacaaagagacacctctctacattctctgcacggctggaatgagaatcctccccgaaagccagcagaaagctattctggaagaccttctgaccgatatccccgtgcactttgactttctgttttctgactctcatgcagaagtaatttctgggaaacaagaaggtgtgtatgcttggattggcattaattttgtccttggacgatttgagcatattgaagatgatgatgaggccgttgtggaagttaacattcctggaagtgaaagcagcgaagccattgtccgtaaaaggacagcgggcattctcgacatgggcggcgtgtcgactcagatagcgtacgaagtccccaaaactgtaagctttgcgtcctcacagcaggaagaagtagctaaaaacttgttagctgaatttaacttgggatgtgatgttcaccaaactgagcatgtgtatcgagtctatgtggccacgtttcttgggtttggtggcaatgctgctcgacagagatacgaagacagaatatttgccaacaccattcaaaagaacaggctcctgggtaaacagactggtctgactcctgatatgccgtacttggacccctgcctacccctagacattaaagatgaaatccagcaaaatggacaaaccatatacctacgagggactggagactttgacctgtgtcgagagactatccagcctttcatgaataaaacaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggattattgtgcaacaaagtggtccattttgcgggaacgctttgaccgaggactgtacgcctctcatgctgacctccacaggcttaagtatcagtgcttcaaatcggcctggatgtttgaggtgtttcataggggcttttcgtttcctgtcaactataaaagcttaaagactgccttgcaagtttacgacaaggaggttcagtggacccttggagccatcctctacaggacccgctttctaccattaagagacatccagcaggaggccttccgagccagtcacacccactggcggggcgtttcctttgtctacaaccactacctgttctctggctgcttcctggtggtgctgctggccatcctgctgtacctgctgcggctgcggcgcatccacaggcgcactccccggagcagctcggccgccgccctctggatggaggagggccttcccgcccagaatgccccggggaccttgtgatccagctcacagctccacgaagactcaaaaggaaaagccatttttgcctcagggtttctcctctttattttcctgtggttttgttttttctttcccttttttgttcctccaaacaaaaacaaaatgcaggccgagcgcggtggctcacgcctgtaatcccagcactttgggaggccgaggcgggcggatcatgaggtcaggagatcgagaccatcctggctaacacggtgaaaccccgtctctactaaaaatacaaaaaattagctgggtgtggtggcgggcgcccgtagtcccagctactcaggaggctgaggcaggagaatggcatgaacctgggaggcagagcttgcagtgagccgagatcacaccactgcactccagcctgggcgacagagtgagactccgtctcaaaaaaaaaaaatgcattgtttataagccctgctgtctagaagtattgcgtttagccattttgagtacagcattaaattgaggagtggggaagagggaaattcacttgatttttgctgcacaggatatctgccaaaaataaatgagatttctggggtttctctaaggaatgttaaatttaaacacatgcactttgatactggagggaggtggaaagatgcattctgtcagtggagaggggactgaatagtgatgctttcatagaaccaaaaaacttactgcctgaaatgataatcctcttttttctctatcttgaaagctctaacctgaagagggtgatttttttttttatttattgttcaggtctgttactgtatatgttttctttgcaaatttaaattttttaaaccatttatatccaaaacagagaaacatgggcaccaggagataaccatttataaaagtgatagtgaactatcgactacagctttgtgcgagtgtgtgaaaaatcccaagaaaccagcgtgaggggaggcaatgctggttctttaaaaacacacacttcagaatttactggtacattttatttagaaaaatcctcgttactgttatcttttcctgaccgcaggtaattacgctccttattccatatttcagtggcattagaacactgtggttttgaaagaattggaaattcctagtttcaccagtttcggttttattggaactagagcacatgcccacttcttgctcagtattcctcagtgtttctgcttaatcgtgcctcagtttcttccagcttccaattggtgtttcccccaccccccttaattaaaagtcatctcagcttttaatcgtactgggagaccccatgcacagcctgccgagtcctcttcctaaccgcattgactgaggctgttgctggcagcaccactgtaaatccagaagggaagagtctgcatccaatacaggaaataaattcacattttgaaggaaaaaattcgacaatttaagccaaaatctaaaaaggacaattggattggcatatgtgagattggtgttttttcacctatttatttagttgagaagtttggggaattctcgtacagtttttttaggtggagtttgttttgtgcgagtgtctgtgtgtgctgttccctaactccagaacagttaaattcctgtagttggtagcagattagtacccagaagtggggttgttgctataacagataactgaggatattataaaagtggctttggaactaggtactgggcagaggctgggagagtttggagaaacaggagagaaaaggcctgtattgccatgaactgagcattaggggcagttctgctgagggatcagaagagaagaccaagggaattctgtcccagttgtggctcaaactgcctcaggtgcagcttaacctgcgtctctggaaggtaaaatgcatctgatccttgaggcaagagctgtgggggcatggctccctcacctggatttcaaagcgtgttaccagcagcctggggacccaggctctgcctctggatttacctgcatcgtatttgcgcttcgtggtcaaagttgttaagaaaggggtgagcttctggctacctaataagttggtcttggccacctgcctgcgacacttcctggaggagccatggattattggtggaggctgcagggagctggcgatggagccactggtgtcagcagcagagagggaagaaaggaaaggaaggggccacaaatggttgaagtgggcaggtgggcacccagggagttaggggaccccgccttccagctctgggcatagaagagttagtcacatacctgaggatcctgaaacaagggctgagaaaacctcattgctccagctgagaggtagtagtggatttgccatttttaaacagttgcctaagaaaaaacgttgaagaatatgcagcagacactatatgtggcctgtaaagcctagaatatttactaaaatatttacagaaaaagtttgctggtccttgtgagaacaatgcagttcaaaaaaggatacagacagaagcatcctcttaaatcaggaatgtagtttccatttgtgggcacgaaaagatggacaagagaagtaaccaaacttcaatcttaaaatatttgttgcaccagaatttcacttcggatttttccgtctagattattttcaagatgagttttgaaacaaaccaagaaacctgcccctcacccaaaattgtttaaaaagagaccactcaagggagttcattatgccgtatggagatgtctgcagtcgcagcaaatcacattccagagaaggtctcgcgtaggtgaagacagccaggtgctttctctaagagatacagggtgggtgagagacaagccagggaggatcttaattcaagagaagaattcataccaagagctgaccaagaaggcagtaaattctgtgtacttgtagcagaagaaattggactaggaacttgcccaaagctttatcaaagaaaagcattgtgttcaatcttggtagaaacatgccagcaataagtgcttatgttccatagccatatcatgggcttctcacttttaaacctcctccaggggatgttctcagacatttcacaatccctctggggacattacagtagaagagaaacacatggaactgtaccagtgctttttgcccatgttcatcctaagctccggctttaggcagtgctttctgacctgggcggagtgaagacgctgctggtggctgaggccagtaacatggggcccctgcccagccaccctgaaggctgggtaggtccctcttttcaccaccagttttccacatctgtgtactctagattaacaaactctggataaacagatatttacattttaaactcaggcctacacagagtagttttccttataaggagcatgtatcacttagcaagaaactaaaaatggcaaatgagtttttcatcctttaagaaaaaaatcagctttagaattctctgcggtcagttgtgtgcaatgcaacaaaactacctttcagtaaattacttagttatttatttcagtgttttgtttcttttgatactaagtttccctttcaataatgaatgatgtgaccaaccaaggagaatttgtttgttctgtactaaaattatattttacagttaggaattataaaaagcaagggagcatctttaaatgttttttgtttaagcgatgtcttccatccaaagtaagaataatactctcggaaggtccttttggtgtcatgtcacttgctgtatgtggcagccttacagtgccacacttgggtactgaaaaatcaataaaacgaaagttcatcatcccatggcccgtag

SEQ ID NO: 2030 - DNA, 2063 bp, Homo sapiens
gcaggcggtgacgtgttgccggcgggggccgggcgggggtgcggctccaggaaaggagcgcggcctccaggaagccggctggccgtgatgctgcccactggtggtcccccgctcccggggtccccggccggccaagcaggagggctctaactccgtgaggaccccagcattatttctataattgtttgtgagaaggactgaatcccagagcattgccttgttgctgacctttcagtatggggaggattggcatctcctgtctttttcctgcttcttggcattttagcatatctccagtagggtgtcctcgaattctgaataccaatttacgccaaattatggtcattagtgtcctggctgctgctgtttcacttttatatttttctgttgtcataatccgaaataagtatgggcgactaaccagagacaagaaatttcaaaggtacctggcacgagttaccgacattgaagctacagacaccaataaccccaatgtgaactatgggatcgtggtggactgtggtagcagtgggtctcgagtatttgtttactgctggccaaggcataatggcaatccacatgatctgttggatatcaggcaaatgagggataaaaaccgaaagccagtggtcatgaagataaaaccgggcatttcagaatttgctacctctccagagaaagtcagtgattacatttctccacttttgaactttgctgcagagcatgtgccacgggcaaaacacaaagagacacctctctacattctctgcacggctggaatgagaatcctccccgaaagccagcagaaagctattctggaagaccttctgaccgatatccccgtgcactttgactttctgttttctgactctcatgcagaagtaatttctgggaaacaagaaggtgtgtatgcttggattggcattaattttgtccttggacgatttgagcatattgaagatgatgatgaggccgttgtggaagttaacattcctggaagtgaaagcagcgaagccattgtccgtaaaaggacagcgggcattctcgacatgggcggcgtgtcgactcagatagcgtacgaagtccccaaaactgaagaagtagctaaaaacttgttagctgaatttaacttgggatgtgatgttcaccaaactgagcatgtgtatcgagtctatgtggccacgtttcttgggtttggtggcaatgctgctcgacagagatacgaagacagaatatttgccaacaccattcaaaagaacaggctcctgggtaaacagactggtctgactcctgatatgccgtacttggacccctgcctacccctagacattaaagatgaaatccagcaaaatggacaaaccatatacctacgagggactggagactttgacctgtgtcgagagactatccagcctttcatgaataaaacaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggattattgtgcaacaaagtggtccattttgcgggaacgctttgaccgaggactgtacgcctctcatgctgacctccacaggcttaagtatcagtgcttcaaatcggcctggatgtttgaggtgtttcataggggcttttcgtttcctgtcaactataaaagcttaaagactgccttgcaagtttacgacaaggaggttcagtggacccttggagccatcctctacaggacccgctttctaccattaagagacatccagcaggaggccttccgagccagtcacacccactggcggggcgtttcctttgtctacaaccactacctgttctctggctgcttcctggtggtgctgctggccatcctgctgtacctgctgcggctgcggcgcatccacaggcgcactccccggagcagctcggccgccgccctctggatggaggagggccttcccgcccagaatgccccggggaccttgtga

SEQ ID NO: 2031 - DNA, 3550 bp, Homo sapiens
cttccggctgggcaaggggccgcggggagcagctcgggactgaaccgagaggtgccgaaggaaccggcgggccgcttgatcccgctgcagacgtaggagatgcctgggacaaggaggccaccttctcagggcaaaagaaaaagaaggtgacaggcgttgagaccaccgaagggaacccatggctaggatcagtttttcctacctctgcccagcctcctggtacttcactgtgcccacagtgagtccatttctccgtcagcgggtggcattcctgggactcttcttcatatcctgtctccttttacttatgttaatcatagactttcgacattggagtgcttcattaccacgagataggcaatacgaaaggtatttggctcgagtaggggagcttgaagctactgacactgaagacccaaatctgaattatggacttgttgttgactgtggcagcagtggttcccggatttttgtttatttctggccaagacataatgggaacccccatgacttgctggacatcaaacagatgagagaccgcaacagccaaccagtggttaaaaaaatcaagccaggaatctctgcaatggcagacactccagaacatgccagtgattaccttcgtcctctgctgagctttgctgctgctcatgtgcctgtgaagaagcacaaggagacccctctttacatcctctgcacagcaggcatgaggcttctccctgagaggaagcagttggctatcttggctgacctagtgaaagatttaccactggagtttgacttcctcttttcacagtctcaagcagaagtgatctctgggaagcaggaaggggtttatgcatggattggaatcaactttgttttgggaagattcgaccacgaggatgaatcagatgctgaggctacccaggaattggcagcaggacggagaaggacagtagggatactggatatgggaggagcctctctccaaattgcttatgaagttcctacctcaacctctgtccttcctgcaaagcaggaagaagctgccaagatcctgctggctgagttcaacctgggctgtgatgtgcaacacactgaacacgtgtacagggtttatgtcacaacttttctgggtttcggaggcaactttgcccggcagcgctacgaagaccttgttctgaatgaaactcttaacaaaaacagattgcttggtcagaagacaggtctgagtcccgacaatccatttctggatccctgcctgccagtgggactcacagatgtggtggagaggaacagccaagtcttacatgtccgaggaagaggagactgggtgtcttgtggggcaatgctgagccccctgctggctcgctccaacaccagccaggcctcactcaatggcatatatcaatcgcctattgacttcaacaacagcgagttctacggcttctctgagtttttttattgtacagaggatgtgttgcgcattggtggccgctaccatgggccaacatttgccaaggctgctcaggattactgtggcatggcttggtcggtactaactcagagattcaagaatggcctcttttcatcacatgcagatgagcatcgactcaaatatcagtgttttaaatcggcttggatgtaccaagtcttacatgaaggattccactttccctatgactacccaaacctgcggacagcccagctggtgtatgaccgagaggttcagtggacgctgggagccattctatataaaacacgattcttaccactcagggatcttcggcaggaaggtgtccgacaagcccatggtagctggttccgtctctcctttgtatacaaccactatctcttctttgcctgtatcctggtggtgctactggccatcttcctataccttctgcggctacgccgaattcaccaccgacaaacacgagcctcagctccattggacttgctgtggcttgaagaggtggtgcccatgatgggagtacaggtggggccgtgaggctggaccaggactagagaagcttgagcacccccgagttgctgctcattgaattcctccactttcttatatagcctcagatgctgtgatgtctgaccttgtggatatttgcccttggaatttctactttactttctaccgtaattccttctccgtacccaggtcttctctgagagaagctataatttaatctgtgaggaactaaatgacaggagattggtgctaatacgggggaccaagctttgtccaagtgaagcaggcttcgactccttctgagaggtctggtgtgttcctagaatctcaccttttcttcccttgctaaagcatgaagtttggcatttggcacactggaagcctggttgaaatgaaatttgtagcatctgatacaaagccagagacattctagcaagtgcagcagccccttctttctctgtaacagagatatcatttatgtggagatccacaacctttaacagggatccaagatctttgcagttcaatcgaccacataggaatttccaggcaccaaaatgatataacttccttgcttccttgacaaagaagccatcatgggtgtgatccaagatccctgtcgtagtgttgatgatgttagtacatgattttaaaggttagaaccccttctaaatgaatggtctgtggaagattttagtatcttatctgatgcctggtatgatgaggatagaaaatttttccatttttatgtgcctcacaggctgtttgggcattaattttgctttttgagccttaagtgtgttagtaggatggagaaactgtgatggggactgggaacctggatttgtctgattttaggtcactgttccctgggcctgtttttgtgagcccttacacaggaagatataaagagagttctttcatttcactgctaaaatcagtatgtagtatggggaatgtatttgggttgtttttaaagaaaaggggaacagaatcaggagagtgggcaaaggcaataaaatcaaagttcttattaattatttctgagaaatagaagtttctcaatttatgactcttggaatgtctgaaagggagcaaatttggaatagatcaatctgttaataagccatctggcaactttcagaacctctattaagagactgctgagtcacaaacagcacttccattaatgaagcgagaggaaaagccataataattacatcttcacccactacccttccagagctttgcttctcctccacatttagccattaaattgcatgaggatttctcttcatcagggtccgcatggaatctttcttatattttaccctttcctacatgtagccttgaatgtcctttccacgaatatgctcccacggctgggagcattttcttttcttttcgtcacctttgatttttgggattagattaataggggaaaaagtccctggctttaaagaaaacaaaagtagaattcttcaaaaataaatttcatactgggaacagaaaggaactaaatgcttcataaaacagggaaaaagaaattaagatcatcctagaaataaactaagataaaaataa

SEQ ID NO: 2032 - DNA, 2111 bp, Homo sapiens
ccaggtgcacagcgcatcgcccgaggctgtcaccgccctgccccgcccaccccagctgtcctggacccaggggcagggagaggctggacgccaggtgcgcggacacagaagcgtctaagcacagcttcctccttgccgctccgggaagtgggcagccagcccaggaaccagtaccacctgcaccatggggctgtcccggaaggagcaggtcttcttggccctgctgggggcctcgggggtctcaggcctcacggcactcattctcctcctggtggaggccaccagcgtgctcctgcccacagacatcaagtttgggatcgtgtttgatgcgggctcctcccacacgtccctcttcctgtatcagtggctggcgaacaaggagaatggcacgggtgtggtcagccaggccctggcctgccaggtggaagggcctggaatctcctcctacacttctaatgctgcacaggctggtgagagcctgcagggctgcttggaggaggcgctggtgctgatcccagaggcccagcatcggaaaacacccacgttcctgggggccacggctggcatgaggttgctcagccggaagaacagctctcaggccagggacatctttgcagcagtcacccaggtcctgggccggtctcccgtggacttttggggtgccgagctcctggccgggcaggccgaaggtgcctttggttggatcactgtcaactacggcttggggacgctggtcaagtactccttcactggagaatggatccagcctccggaggagatgctggtgggtgccctggacatgggaggggcctccacccagatcacgttcgtgcctgggggccccatcttggacaagagcacccaggccgattttcgcctctacggctccgactacagcgtctacactcacagctacctgtgctttggacgggaccagatgctgagcaggctcctcgtggggctggtacagagccgcccggctgccctgctccgtcacccgtgctacctcagcggctaccagaccacactggccctgggcccgctgtatgagtcaccctgtgtccacgccacgcccccgctgagcctcccccagaacctcacagttgaagggacaggcaaccctggagcctgcgtctcagccatccgggaacttttcaacttctccagctgccagggccaggaggactgcgcctttgacggggtctaccagcccccgctgcggggccagttctatgtggaggccagctaccctgggcaggaccgctggctgcgggactactgtgcctcaggcctgtacatcctcaccctcctgcacgagggctacgggttcagcgaggagacctggcccagcctcgagttccgaaagcaggcgggcggtgtggacattggctggacactgggctacatgctgaacctgaccgggatgatcccggccgatgcgccggctcagtggcgggcagagagctacggcgtctgggtggccaaagtggtgttcatggtgctggccctggtggcggtggtgggggctgccttggtccagctcttctggttgcaggactagtgggaaggcggaggtgggcccccacagagcccacaggcagctgcgtcccggatgctggaggcttcctgagccctgagcgccgtggggccttgctctgtggctctgcccacggtcaggtgacagccacctccagggcaccgtcagggtggtgctggccacagaggctgcatgacctcccctcccggcgtccctcccccaacctccttccgcaactgggcttccagggccgtaggtgcctttctgcacacaggccgccaggactcgtggtgtctccaggctgtgtgactgcagggccacatgctgcctgcaaacagggcaagaccacggaggcacaggggtcctgctcctgatggggcctcaggaggggcggagaggggtggaagggagggagctgccccacctggacccccgctctccctgctgttgtctgagcagatggatggagtccaggcctgggggcttctgctgggccagcccggcctcccacacccacttggagggtgagactgcagtgggggttgtttttattaaaagcatcatggacacagca

SEQ ID NO: 2033 - DNA, 2222 bp, Homo sapiens
ccaggtgcacagcgcatcgcccgaggctgtcaccgccctgccccgcccaccccagctgtcctggacccaggggcagggagaggctggacgccaggtgcgcggacacagaagcgtctaagcacagcttcctccttgccgctccgggaagtgggcagccagcccaggaaccagtaccacctgcaccatggggctgtcccggaaggagcaggtcttcttggccctgctgggggcctcgggggtctcaggcctcacggcactcattctcctcctggtggaggccaccagcgtgctcctgcccacagacatcaagtttgggatcgtgtttgatgcgggctcctcccacacgtccctcttcctgtatcagtggctggcgaacaaggagaatggcacgggtgtggtcagccaggccctggcctgccaggtggaagggcctggaatctcctcctacacttctaatgctgcacaggctggtgagagcctgcagggctgcttggaggaggcgctggtgctgatcccagaggcccagcatcggaaaacacccacgttcctgggggccacggctggcatgaggttgctcagccggaagaacagctctcaggccagggacatctttgcagcagtcacccaggtcctgggccggtctcccgtggacttttggggtgccgagctcctggccgggcaggccgaaggtgcctttggttggatcactgtcaactacggcttggggacgctggtcaagtactccttcactggagaatggatccagcctccggaggagatgctggtgggtgccctggacatgggaggggcctccacccagatcacgttcgtgcctgggggccccatcttggacaagagcacccaggccgattttcgcctctacggctccgactacagcgtctacactcacagctacctgtgctttggacgggaccagatgctgagcaggctcctcgtggggctggtacagagccgcccggctgccctgctccgtcacccgtgctacctcagcggctaccagaccacactggccctgggcccgctgtatgagtcaccctgtgtccacgccacgcccccgctgagcctcccccagaacctcacagttgaagggacaggcaaccctggagcctgcgtctcagccatccgggaacttttcaacttctccagctgccagggccaggaggactgcgcctttgacggggtctaccagcccccgctgcggggccagttctatgccttctccaacttctactacaccttccacttcctgaacctcacctccaggcagcccctgagcacggtcaacgccaccatctgggagttttgccagaggccctggaaactggtggaggccagctaccctgggcaggaccgctggctgcgggactactgtgcctcaggcctgtacatcctcaccctcctgcacgagggctacgggttcagcgaggagacctggcccagcctcgagttccgaaagcaggcgggcggtgtggacattggctggacactgggctacatgctgaacctgaccgggatgatcccggccgatgcgccggctcagtggcgggcagagagctacggcgtctgggtggccaaagtggtgttcatggtgctggccctggtggcggtggtgggggctgccttggtccagctcttctggttgcaggactagtgggaaggcggaggtgggcccccacagagcccacaggcagctgcgtcccggatgctggaggcttcctgagccctgagcgccgtggggccttgctctgtggctctgcccacggtcaggtgacagccacctccagggcaccgtcagggtggtgctggccacagaggctgcatgacctcccctcccggcgtccctcccccaacctccttccgcaactgggcttccagggccgtaggtgcctttctgcacacaggccgccaggactcgtggtgtctccaggctgtgtgactgcagggccacatgctgcctgcaaacagggcaagaccacggaggcacaggggtcctgctcctgatggggcctcaggaggggcggagaggggtggaagggagggagctgccccacctggacccccgctctccctgctgttgtctgagcagatggatggagtccaggcctgggggcttctgctgggccagcccggcctcccacacccacttggagggtgagactgcagtgggggttgtttttattaaaagcatcatggacacagca

SEQ ID NO: 2034 - DNA, 1749 bp, Homo sapiens
ccagtaccacctgcaccatggggctgtcccggaaggagcaggtcttcttggccctgctgggggcctcgggggtctcaggcctcacggcactcattctcctcctggtggaggccaccagcgtgctcctgcccacagacatcaagtttgggatcgtgtttgatgcgggctcctcccacacgtccctcttcctgtatcagtggctggcgaacaaggagaatggcacgggtgtggtcagccaggccctggcctgccaggtggaagggcctggaatctcctcctacacttctaatgctgcacaggctggtgagagcctgcagggctgcttggaggaggcgctggtgctgatcccagaggcccagcatcggaaaacacccacgttcctgggggccacggctggcatgaggttgctcagccggaagaacagctctcaggccagggacatctttgcagcagtcacccaggtcctgggccggtctcccgtggacttttggggtgccgagctcctggccgggcaggccgaaggtgcctttggttggatcactgtcaactacggcttggggacgctggtcaagtactccttcactggagaatggatccagcctccggaggagatgctggtgggtgccctggacatgggaggggcctccacccagatcacgttcgtgcctgggggccccatcttggacaagagcacccaggccgattttcgcctctacggctccgactacagcgtctacactcacagctacctgtgctttggacgggaccagatgctgagcaggctcctcgtggggctggtacagagccgcccggctgccctgctccgtcacccgtgctacctcagcggctaccagaccacactggccctgggcccgctgtatgagtcaccctgtgtccacgccacgcccccgctgagcctcccccagaacctcacagttgaagggacaggcaaccctggagcctgcgtctcagccatccgggaacttttcaacttctccagctgccagggccaggaggactgcgcctttgacggggtctaccagcccccgctgcggggccagttctatgccttctccaacttctactacaccttccacttcctgaacctcacctccaggcagcccctgagcacggtcaacgccaccatctgggagttttgccagaggccctggaaactggtggaggccagctaccctgggcaggaccgctggctgcgggactactgtgcctcaggcctgtacatcctcaccctcctgcacgagggctacgggttcagcgaggagacctggcccagcctcgagttccgaaagcaggcgggcggtgtggacattggctggacactgggctacatgctgaacctgaccgggatgatcccggccgatgcgccggctcagtggcgggcagagagctacggcgtctgggtggccaaagtggtgttcatggtgctggccctggtggcggtggtgggggctgccttggtccagctcttctggttgcaggactagtgggaaggcggaggtgggcccccacagagcccacaggcagctgcgtcccggatgctggaggcttcctgagccctgagcgccgtggggccttgctctgtggctctgcccacggtcaggtgacagccacctccagggcaccgtcagggtggtgctggccacagaggctgcatgacctcccctcccggcgtccctcccccaacctccttccgcaactgggcttccagggccgtaggtgcctttctgc

SEQ ID NO: 2035 - DNA, 4679 bp, Homo sapiens
agacgctcgcctggcagctgcgcacactcggagcgccccgagcggcgcagatagggacgttggggctgtgccccgcggcgcggcgcctgccactgcgcaggcgcctcaggaagagctcggcatcgcccctcttcctccaggtcccccttccccgcaacttcccacgagtgccaggtgccgcgagcgccgagttccgcgcattggaaagaagcgaccgcggcggctggaaccctgattgctgtccttcaacgtgttcattatgaagttattagtaatacttttgttttctggacttataactggttttagaagtgactcttcctctagtttgccacctaagttactactagtatcctttgatggcttcagagctgattatctgaagaactatgaatttcctcatctccagaattttatcaaagaaggtgttttggtagagcatgttaaaaatgtttttatcacaaaaacatttccaaaccactacagtattgtgacaggcttgtatgaagaaagccatggcattgtggctaattccatgtatgatgcagtcacaaagaaacacttttctgactctaatgacaaggatcctttttggtggaatgaggcagtacctatttgggtgaccaatcagcttcaggaaaacagatcaagtgctgctgctatgtggcctggtactgatgtacccattcacgataccatctcttcctattttatgaattacaactcctcagtgtcatttgaggaaagactaaataatattactatgtggctaaacaattcgaacccaccagtcacctttgcaacactatattgggaagaaccagatgcaagtggccacaaatacggacctgaagataaagaaaacatgagcagagtgttgaaaaaaatagatgatcttatcggtgacttagtccaaagactcaagatgttagggctatgggaaaatcttaatgtgatcattacaagtgatcatgggatgacccagtgttctcaggacagactgataaacctggattcctgcatcgatcattcatactacactcttatagatttgagcccagttgctgcaatacttcccaaaataaatagaacagaggtttataacaaactgaaaaactgtagccctcatatgaatgtttatctcaaagaagacattcctaacagattttattaccaacataatgatcgaattcagcccattattttggttgccgatgaaggctggacaattgtgctaaatgaatcatcacaaaaattaggtgaccatggttatgataattctttgcctagtatgcatccatttctagctgcccacggacctgcatttcacaaaggctacaagcatagcacaattaacattgtggatatttatccaatgatgtgccacatcctgggattaaaaccacatcccaataatgggacctttggtcatactaagtgcttgttagttgaccagtggtgcattaatctcccagaagccatcgcgattgttatcggttcactcttggtgttaaccatgctaacatgcctcataataatcatgcagaatagactttctgtacctcgtccattttctcgacttcagctacaagaagatgatgatgatcctttaattgggtgacatgtgctagggcttatacaaagtgtctttgattaatcacaaaactaagaatacatccaaagaatagtgttgtaactatgaaaaagaatactttgaaagacaaagaacttagactaagcatgttaaaattattactttgttttccttgtgttttgtttcggtgcatttgctaataagataacgctgaccatagtaaaattgttagtaaatcattaggtaacatcttgtggtaggaaatcattaggtaacatcaatcctaactagaaatactaaaaatggcttttgagaaaaatacttcctctgcttgtattttgcgatgaagatgtgatacatctttaaatgaaaatataccaaaatttagtaggcatgtttttctaataaatttatatatttgtaaagaaaacaacagaaatctttatgcaatttgtgaattttgtatattagggaggaaaagcttcctatatttttatatttacctttaattagtttgtatctcaagtaccctcttgaggtaggaaatgctctgtgatggtaaataaaattggagcagacagaaaagatatagcaaatgaagaaatattttaaggaaacctatttgaaaaaaaaagcaaagaccatttgataaaagcctgagttgtcaccattatgtcttaagctgttagtcttaaagattattgttaaaaaattcagaagaaaagagagacaagtgctcttctctctatctatgcttaatgcctttatgtaagttacttagttgtttgcgtgtgcctgtgcaagtgtgtttgtgtgtggttgtgtggacattatgtgatttactatataaggaggtcagagatggactgtggccaggcttccacattcctgaagcacacagatctcaggaaaggttatttttgcacttcatatttgtttactttctcctaactcacaagttaaaatcataacttaatttcattaacttttatcatttaactctctcatgtttgttgtaacctgaggtatccaaatgctacagaaaaatttatgacccaaatacaaatctcaatttgactgggacagaatgaggaatggagatttttgtatttatctttgggactttatgccttactttttaggctatagaatagttaagaaattttaaacaaaatttagtatcttttggtctttcacaccattcatatgttaagtggcagaatagccttagtgctacctccacttttttctccagtatttgcatcacagaaataatccctctgtttaacatgtttgttcagagccaagggtttattgtgaagaactgtcatcctgcctttgctagctggtaccttctagtaatcaaaattaatatgaagaaactaggttgtgacagactagattatatttagtaggggaaaaattgggctcaagaaccattcatcagtacgtgagacaagcagttaatagtatgatctttaaagttttgacaatataaaataaacttggtaactgttttacaaatataaaagtataataaatatgcagcccagttaaatattgattatctgtgatggtaaagaacaacagtggtgccagtcatcaaacatacagtgcgtcctattgagtcactgctaatttcttgagcctggtatttgctgcctattgtatttgtggttgttgagaggcattttcaaaccctgtataaataatccatgctgttggtcataagttaactgtattaagaacagtaaaataaataaaaaccaatagtactaattttgctttaaaaaaatttctaatttttttcacataaaacaattatcctaaaggttaatagttgatcgaaacagaataatagaaaaattctactttaatttccattaaaaagcaaatagcattgacacatttaaagcttttcatttaaagtagtggatgtttttgaagtatctaaaatagtagcagaatattttatacttggtccttgcaatggtgtgagttttaatgattgcattatcgtgattggtggttatgagtttcagaaatctatacttggcatccaactcatgagtggattttatataggatggaacaggaaggtatgtcctgtcagtatcttaaccctttcaacaagacatttacctatttgtctttccttacgttctcaaaatattaactcgaattgtaaattaagcaaaaatttaaaaagtatatgttgatgggacaagaagaatagtatttatttaataaaacatatattatattgaactatgtgttaattcatttgtatcttttaaaaaattatcactgttaaagccattgactcctttagtacactgagaaaaatcttatagtaaaactagcctttcacattaaggttttggtgtgtattttgttaaataactaacatgctgctctattttctgggtgtagaaagtatttggctctaggaaacatttacttgtttgtgaaaacaataccccaaggtaataggaaaagtttgagttaagtgtttttaattcagtcagtgaattcagaataagtacattcatgtataacatagggacagttctgctgctgttatttatatgcaattcttctggtaaatagcaatagaataaaacatatttcaatgtttgtgtataggttttatattattattccactaggaatggcataagaatttatagataaattcttgtaacattaaaggattaaaatgtttttacattgtttttgggtgtctccttcttgtgcccatatctgataagctttatggattattgcatttaattccttttatttggagggttttacttccttgttaacatataaagttataaatgaaggacaaggaggagatggaaaatgtgtatttattgttaattcttaaaatagtgtgtaaataaaataacatcagtgtgctttaaagaaatgtgtatgtagtgccttaatttaaattaaaatatttttgactgttacttgagttcagaattaatgactttgttcatgatttttaaaatgtgtgtgaataaaatctaccaaaaaattcttactgtaattattaaatataaagttcagtgtc

SEQ ID NO: 2036 - DNA, 4494 bp, Homo sapiens
ggagcgccccgagcggcgcagatagggacgttggggctgtgccccgcggcgcggcgcctgccactgcgcaggcgcctcaggaagagctcggcatcgcccctcttcctccaggtcccccttccccgcaacttcccacgagtgccaggtgccgcgagcgccgagttccgcgcattggaaagaagcgaccgcggcggctgggaaccctgattgctgtccttcaacgtgttcattatgaagttattagtaatacttttgttttctggacttataactggttttagaagtgactcttcctctagtttgccacctaagttactactagtatcctttgatggcttcagagctgattatctgaagaactatgaatttcctcatctccagaattttatcaaagaaggtgttttggtagagcatgttaaaaatgtttttatcacaaaaacatttccaaaccactacagtattgtgacaggcttgtatgaagaaagccatggcattgtggctaattccatgtatgatgcagtcacaaagaaacacttttctgactctaatgacaaggatcctttttggtggaatgaggcagtacctatttgggtgaccaatcagcttcaggaaaacagatcaagtgctgctgctatgtggcctggtactgatgtacccattcacgataccatctcttcctattttatgaattacaactcctcagtgtcatttgaggaaagactaaataatattactatgtggctaaacaattcgaacccaccagtcacctttgcaacactatattgggaagaaccagatgcaagtggccacaaatacggacctgaagataaagaaaacatgagcagagtgttgaaaaaaatagatgatcttatcggtgacttagtccaaagactcaagatgttagggctatgggaaaatcttaatgtgatcattacaagtgatcatgggatgacccagtgttctcaggacagactgataaacctggattcctgcatcgatcattcatactacactcttatagatttgagcccagttgctgcaatacttcccaaaataaatagaacagaggtttataacaaactgaaaaactgtagccctcatatgaatgtttatctcaaagaagacattcctaacagattttattaccaacataatgatcgaattcagcccattattttggttgccgatgaaggctggacaattgtgctaaatgaatcatcacaaaaattaggtgaccatggttatgataattctttgcctagtatgcatccatttctagctgcccacggacctgcatttcacaaaggctacaagcatagcacaattaacattgtggatatttatccaatgatgtgccacatcctgggattaaaaccacatcccaataatgggacctttggtcatactaagtgcttgttagttgaccagtggtgcattaatctcccagaagccatcgcgattgttatcggttcactcttggtgttaaccatgctaacatgcctcataataatcatgcagaatagactttctgtacctcgtccattttctcgacttcagctacaagaagatgatgatgatcctttaattgggtgacatgtgctagggcttatacaaagtgtctttgattaatcacaaaactaagaatacatccaaagaatagtgttgtaactatgaaaaagaatactttgaaagacaaagaacttagactaagcatgttaaaattattactttgttttccttgtgttttgtttcggtgcatttgctaataagataacgctgaccatagtaaaattgttagtaaatcattaggtaacatcttgtggtaggaaatcattaggtaacatcaatcctaactagaaatactaaaaatggcttttgagaaaaatacttcctctgcttgtattttgcgatgaagatgtgatacatctttaaatgaaaatataccaaaatttagtaggcatgtttttctaataaatttatatatttgtaaagaaaacaacagaaatctttatgcaatttgtgaattttgtatattagggaggaaaagcttcctatatttttatatttacctttaattagtttgtatctcaagtaccctcttgaggtaggaaatgctctgtgatggtaaataaaattggagcagacagaaaagatatagcaaatgaagaaatattttaaggaaacctatttgaaaaaaaaagcaaagaccatttgataaaagcctgagttgtcaccattatgtcttaagctgttagtcttaaagattattgttaaaaaattcagaagaaaagagagacaagtgctcttctctctatctatgcttaatgcctttatgtaagttacttagttgtttgcgtgtgcctgtgcaagtgtgtttgtgtgtggttgtgtggacattatgtgatttactatataaggaggtcagagatggactgtggccaggcttccacattcctgaagcacacagatctcaggaaaggttatttttgcacttcatatttgtttactttctcctaactcacaagttaaaatcataacttaatttcattaacttttatcatttaactctctcatgtttgttgtaacctgaggtatccaaatgctacagaaaaatttatgacccaaatacaaatctcaatttgactgggacagaatgaggaatggagatttttgtatttatctttgggactttatgccttactttttaggctatagaatagttaagaaattttaaacaaaatttagtatcttttggtctttcacaccattcatatgttaagtggcagaatagccttagtgctacctccacttttttctccagtatttgcatcacagaaataatccctctgtttaacatgtttgttcagagccaagggtttattgtgaagaactgtcatcctgcctttgctagctggtaccttctagtaatcaaaattaatatgaagaaactaggttgtgacagactagattatatttagtaggggaaaaattgggctcaagaaccattcatcagtacgtgagacaagcagttaatagtatgatctttaaagttttgacaatataaaataaacttggtaactgttttacaaatataaaagtataataaatatgcagcccagttaaatattgattatctgtgatggtaaagaacaacagtggtgccagtcatcaaacatacagtgcgtcctattgagtcactgctaatttcttgagcctggtatttgctgcctattgtatttgtggttgttgagaggcattttcaaaccctgtataaataatccatgctgttggtcataagttaactgtattaagaacagtaaaataaataaaaaccaatagtactaattttgctttaaaaaaatttctaatttttttcacataaaacaattatcctaaaggttaatagttgatcgaaacagaataatagaaaaattctactttaatttccattaaaaagcaaatagcattgacacatttaaagcttttcatttaaagtagtggatgtttttgaagtatctaaaatagtagcagaatattttatacttggtccttgcaatggtgtgagttttaatgattgcattatcgtgattggtggttatgagtttcagaaatctatacttggcatccaactcatgagtggattttatataggatggaacaggaaggtatgtcctgtcagtatcttaaccctttcaacaagacatttacctatttgtctttccttacgttctcaaaatattaactcgaattgtaaattaagcaaaaatttaaaaagtatatgttgatgggacaagaagaatagtatttatttaataaaacatatattatattgaactatgtgttaattcatttgtatcttttaaaaaattatcactgttaaagccattgactcctttagtacactgagaaaaatcttatagtaaaactagcctttcacattaaggttttggtgtgtattttgttaaataactaacatgctgctctattttctgggtgtagaaagtatttggctctaggaaacatttacttgtttgtgaaaacaataccccaaggtaataggaaaagtttgagttaagtgtttttaattcagtcagtgaattcagaataagtacattcatgtataacatagggacagttctgctgctgttatttatatgcaattcttctggtaaatagcaatagaataaaacatatttcaatgtttgtgtataggttttatattattattccactaggaatggcataagaatttatagataaattcttgtaacattaaaggattaaaatgtttttacattgtttttgggtgtctccttcttgtgcccatatctgataagctttatggattattgcatttaattccttttatttggagggttttacttccttgttaacatataaagttataaatgaaggacaaggaggagatggaaaatgtgtatttattgttaattcttaaaatagtgtgtaaataaaataacatcagtgtgcttt

SEQ ID NO: 2037 - DNA, 1841 bp, Homo sapiens
gtccatctggaaggcccagcatgagaggcctggccgtcctcctcactgtggctctggccacgctcctggctcccggggccggagcaccggtacaaagtcagggctcccagaacaagctgctcctggtgtccttcgacggcttccgctggaactacgaccaggatgtggacacccccaacctggacgccatggcccgagacggggtgaaggcacgctacatgacccccgcctttgtcaccatgaccagcccctgccacttcaccctggtcaccggcaaatatatcgagaaccacggggtggttcacaacatgtactacaacaccaccagcaaggtgaagctgccctaccacgccacgctgggcatccagaggtggtgggacaacggcagcgtgcccatctggatcacagcccagaggcagggcctgagggctggctccttcttctacccgggcgggaacgtcacctaccaaggggtggctgtgacgcggagccggaaagaaggcatcgcacacaactacaaaaatgagacggagtggagagcgaacatcgacacagtgatggcgtggttcacagaggaggacctggatctggtcacactctacttcggggagccggactccacgggccacaggtacggccccgagtccccggagaggagggagatggtgcggcaggtggaccggaccgtgggctacctccgggagagcatcgcgcgcaaccacctcacagaccgcctcaacctgatcatcacatccgaccacggcatgacgaccgtggacaaacgggctggcgacctggttgaattccacaagttccccaacttcaccttccgggacatcgagtttgagctcctggactacggaccaaacgggatgctgctccctaaagaagggaggctggagaaggtgtacgatgccctcaaggacgcccaccccaagctccacgtctacaagaaggaggcgttccccgaggccttccactacgccaacaaccccagggtcacacccctgctgatgtacagcgaccttggctacgtcatccatgggagaattaacgtccagttcaacaatggggagcacggctttgacaacaaggacatggacatgaagaccatcttccgcgctgtgggccctagcttcagggcgggcctggaggtggagccctttgagagcgtccacgtgtacgagctcatgtgccggctgctgggcatcgtgcccgaggccaacgatgggcacctagctactctgctgcccatgctgcacacagaatctgctcttccgcctgatggaaggcctactctcctgcccaagggaagatctgctctcccgcccagcagcaggcccctcctcgtgatgggactgctggggaccgtgattcttctgtctgaggtcgcataacgccccatggctcaaggaagccgccgggagctgcccgcaggccctgggccggctgtctcgctgcgatgctctgctggtcgcggacggaccctgcctccccagcttatcccaggccagaggctgcatgccactgtccccggcagcgccaacccctgcttggctgttatggtgctggtaataagcctcgcagcccaggtccagagcccccggcgagccggtcccataaccggccccctgcccctgcccctgctcctgctcctccccttcgggccccctcctcctgcaaaacccgctcccgaagcggcgctgccgtctgcagccacgcgggggcgcgcgggagctctgcgggcgctggaacctgcagacccggcctcggtcagctgggaggggcccgccccggcacaaagcacccatgggaataaaggccaagccgcgacagtcagc

SEQ ID NO: 2038 - DNA, 1920 bp, Homo sapiens
gagagttcccaagcggtaggcggcggcgccgggagagaagcgccgcctagctgcgcttccgcaaagatggcggcggctgcgggtagctgcgcgcgggtggcggcctggggcggaaaactgcgacgggggctcgctgtcagccgacaggctgtgcggagtcccggccccttggcagcggcagtggccggcgcggccctggcaggagcaggagcggcctggcaccacagccgcgtcagtgttgcggcgcgggatggcagttttacagtctccgcacagaaaaatgttgaacatggaataatatatattgggaaaccgtctcttcgtaagcagcgcttcatgcagttttcttcactcgaacatgaaggagaatattatatgacaccacgagacttcctcttctcagtgatgtttgagcaaatggaacgtaaaacttcagtcaagaagctgacaaaaaaggacatcgaggatacactgtcagggatccaaacagctggctgtggatcaacttttttcagagaccttggcgataaagggctaatttcatataccgagtatcttttcttgcttacaatcctcactaaaccccattctggatttcatgttgcttttaaaatgctggatacagatggtaatgagatgattgaaaaaagggaattttttaagctgcagaagatcataagtaaacaagatgacttgatgacagtgaaaactaatgaaactggatatcaggaagcaatagtgaaagaacctgaaattaacacaactcttcagatgcgtttctttggaaaaagaggacaaagaaaacttcattataaagaatttcgaagatttatggaaaatttacaaacagagattcaagaaatggaattccttcagttttctaaaggtttgagtttcatgagaaaagaagactttgcagagtggctactttttttcactaacactgaaaataaagatatttattggaaaaatgtgagagagaagttgtcagcaggagagagcattagtttggatgaattcaagtcattttgccattttacaacccacttggaagactttgctattgccatgcagatgttcagtttagctcatcgtcctgtcagactagcggagtttaagagagctgtgaaagtagcaacaggacaagaactctcaaacaatattttggacactgtctttaagatctttgatttggatggtgatgaatgtcttagtcatgaagagtttcttggggtgttaaaaaacagaatgcatcgaggtttatgggtaccacaacatcagagtatacaagaatactggaagtgtgtgaagaaagaaagcattaaaggagtaaaagaagtctggaaacaagctggaaaaggtcttttttaataaaagatataatagtatggcaattatattgttccaaatgtcaaaatttgtgattttttagaagtacttgctatttatcttcttaagtcttcattgatattctgtgtgaaataagcatgtcttgtacttgctttctgattcataattttattaaagaacttagtagaaagaaaagtaagtataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagcatcaattccagacatcttcatgttcctaataggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacataga

SEQ ID NO: 2039 - DNA, 3992 bp, Homo sapiens
gttctctgccccctcccagctctggtgtgggcggcctccgctatggctgcgctgcgaaggctcttgtggccgccaccccgggtgtctcctccactctgcgctcaccagcccctccttgggccgtgggggcggcctgcggtgaccaccctgggccttcctggccggcccttctcctcccgagaggatgaggagagggctgtggcggaggcggcatggaggcggcggcggcgctggggggagctgagcgtggcggcggcggccggcggggggctggtcggcctggtatgctaccagctgtacggggaccccagggccggctcgccggcgaccgggcgaccctcaaagagcgcggccacggagcccgaggacccgccccgcggccgggggatgctgcccatcccagtggcggctgccaaggagacggttgctattggcagaacagacattgaagacttagacctttatgccacatctcgggagaggcgatttcgtttatttgcttctatagaatgtgaagggcagttattcatgactccgtatgattttattttggctgttacaacagatgagcccaaagttgccaaaacttggaagtcactttccaaacaggaattaaatcaaatgctcgcagaaacaccaccagtttggaaaggctcatcgaagctatttcgaaatcttaaagaaaaaggtgtgatttcttacacagaatatctttttcttttatgtattttaacaaagccacatgcagggttcagaatagctttcaacatgtttgacactgatggcaatgagatggtggataaaaaagagtttttggtgcttcaagagatattcaggaaaaaaaatgaaaagagagaaattaaaggagatgaagaaaagcgtgcaatgctgcgtcttcaactttatggataccattctcctactaatagtgtacttaaaacagatgctgaggaacttgtctccagaagctattgggatacactgagacgtaacacaagccaagcactgttttcagacctcgcagagcgtgctgatgacatcacaagtttagtaacagatactacacttcttgtacacttttttggaaagaaaggaaaagctgagctcaactttgaagatttttatagattcatggataatctccaaacagaagttctagaaatagaattcctttcctactcaaatggaatgaataccatcagtgaagaagattttgctcatattcttttacgatatacaaatgtggaaaatacatcagtatttttagaaaatgtgcgttacagtatacctgaagaaaagggcatcacatttgatgaattcaggtcatttttccagtttttaaacaacctagaagactttgcaatagccctgaatatgtataactttgcaagtcgttctatagggcaagatgaatttaaacgtgccgtctatgtagctactggactcaaattttcaccacatttagtgaacactgtcttcaagatttttgatgttgacaaagatgatcaattaagttataaagaatttattggaattatgaaagacagactccatagaggattccggggttataaaacagtccagaagtaccccactttcaaatcctgcctgaagaaagaacttcacagcagataaatactcctaaaacaaagtttaaaggattactatctgtgtgacaaataacaagaagcaacattttgagaatggaagcaggtctgaggtcagaagaagtagagaatgaaggaaaaggtgaatgctatgaaattgatattttttctggaactgaattcttaaacataaaacagataaaatgcatcttgttactacaaatgttatatatataaaatcaagttgagctttgccttgatttgctgaactctctgcactttttcattcccttcagaagtatatagatacttccggtgactacatatgaatgtactttcaatattatttttttatttattcattagaaattttcctcatttcaaaataatttatgactcatggaatgttgatcgcctaaaaatgaacatcgcattttctttgattttggactgtgaacttattttcagagatgaatattgcttgagatttataatacccttagaattaaattcctgttatttgcccagtttttaattacactgagataattttgaaaagaaatagaaattaagctactatataaaacaattgtttacgtgtacttttaacttttaaaagtacttaattaacatatgttgtttgacttgtataaagtttttaaaaattgttgtttatttgccaaagtcaacagaatgtctgttattgttttatgtatacggtaaagaaatttaaagtgtagaattttcctcccccaaaaagtcatgtgttgatagtagaagcagtggtagttgttgtaacagtaatcattgtcattgtcattatcttcttaaacatgaagctgctcctgatcataggtggtacacgttaataacactagtaaaaataacgtcttacactctgtaacttactgcatattgttaatgtatgtctagcatcaaatgagtattgtaaaagactaatataaaatggtttataagactgatgtatatattaagtagaagctaatatttttgtttcttgcaaaaggaccacttgaaaagtgatgctaaacagccagtaataataatttaaatataatttattatttcaaaagaatatgtcttaaaagggaaaataaaaactttctgttgaatcacaacaaaattagatttgtacatagagaaacaatttgataatacttaatagaaatctgttcaattaaaaatgcttagtttatacaaagatactacacaaaaatagaacaattagtctgaattaacgtatttacatattgcatatggaagataagttcatttatcttcctttctaagacatatttaatgtaggttacatacactccaactattactttgcttttgcatatgaaactagaaaacactgactttgtttttataagttattaaatgtgaaattgatctgcatcagcttatttataaaagtaatgttatttccaagaaaatgttactcttagcattgattttgtatgttagactttttacattgtttatctaatattatttatgacagtaattttaaaatatattattcataagttcaaggatcccatatagtataagaatataatttcacttgctttgaaagttgatttaattgactgactaaatgaaaatgcctacccactcatataacatacctcaggtctattttaccttacactgaatgttcttaatatgatttggtacctaaagtaattgaaaaaaatgcagtttcctttaatccttgactataagttatactatgttgcgtacatggcaaatcctgcaaatatagattaaaaattaaattagcccattgaaatcctttataattctgtcattttcccaaggaagaatagcattgtacatatgcaatctttattttattctttattgcttatcagagtgagtggatgaaaacatttgtaaggctgcaacataatattaaaatgtgaataaataaatgttctgataaaatagaaaagaaagtaaattacagtgatttccatcatattatcactcttgaattttatcatctataaaatgagagataaaaatatctcactgaattgttacttatatcaatttaaaatttgctagtggtttgaaaataataatgtactgactacatgtatgctgttattgtcagtgtttccttctataaactgttctttggaaaaattaagttatacataaaattcatattaaactttttacagaaagcatacatgataaacagtttatggtacttctcagaatcatttcataataagcaatttatttagcttaagttccaacttactgttcttattataaattgcaaagcaacctgtcttacattcttacattatcttaaaataaatatttctgcccttgaatcaagaaaca

SEQ ID NO: 2040 - DNA, 2476 bp, Homo sapiens
ggggcccggccaaggcgagtgccgcgcgggccaccatggccacggacgagctggccaccaagctgagccggcggctgcagatggagggcgagggcggcggcgagaccccggagcagcccgggctgaacggggcagcggcggcggcggcgggggcacccgacgaggcggccgaggcgctgggcagcgcggactgcgagctgagcgccaagctgctgcggcgcgcagacctcaaccagggcatcggcgagccccagtcgcccagccgccgcgtcttcaacccctacaccgagttcaaggagttctccaggaagcagatcaaggacatggagaagatgttcaagcagtatgatgccgggcgggacggcttcatcgacctgatggagctaaaactcatgatggagaaacttggggcccctcagacccacctgggcctgaaaaacatgatcaaggaggtggatgaggactttgacagcaagctgagcttccgggagttcctcctgatcttccgcaaggcggcggccggggagcttcaggaggacagcgggctgtgcgtgctggcccgcctctctgagatcgacgtctccagtgagggtgtcaagggggccaagagcttctttgaggccaagtggaactgggtgtgccgctgggctccccggacaggaagcagaggatcaggatggcagcagcttgagcgactcccttcgagcgcccttgctttgcagcagccacagaatataggtccaggccatcaacgtgtccagccgcttcgaggaggagatcaaggcagagcaggaggaaaggaagaagcaggcggaggagatgaagcagcggaaagcggccttcaaggagctgcagtccacctttaagtagcgggggctgcagccgaccgccctgctccggccccagtgtggtgggcgagggtggcgcatgggaggccgagcctgaatccttgcctgtgtctgacgggaccactactaaaaacctaaaaatatctgtgaatggagcaagttcaggggtcttatggaggtggcccggcccctccccgctcccttccactctgcacgaggccgccacaccggcgctggctccctgcccggcccggccctccctggcaatccctgggctctcttgcacccctaactgccccctgcctgctccggcactgccccaggcccagctcctggccctaggtccctcccagccccatgtgcctgccgcctgccctccacacatccctgtccccccaacccgggaacccctgccctcctccagcaggccgcaccgcccctggggccccctgccagccccttcccaggctgggagacggcagaagagatagaatcagggctgcccccacagagtgggacccaaggggctaattggaggcacgaggggacccctccccagggccttttcctcctctgcgtcttccatctactgaaatgggagagggggtggggagcttctgttctggtgaagggacccgggcaggcccccagcaccccatgctgacttggagaaccccagatctctggggcccagccaggcagggtgtgggggcagctgtgccaatctacctcacaggcccaccccctgccgggcatgccgtgggatcatgggcagggaaggctctgggggtcggagacaccgctgcttagcacccccagccagaacaccctgagggtctcggggctctggagagagtggggcgggaggaagaattggcaccttcctagggaaggagacgagcgcttcgccttgattctccgagaagcctccgagaagtgctttaagtgtgtttgcatgcgccaggcggtgggcagcgggggcctgtccagccctctcccgccatccttccccaagtgacgtccactgccttgtcaccagcgacctgcctgtcatgcccaccccctgaggaagcatggggaccctaacaccctggtgccctgcaccagacaggccgtggtcaggcccaggccaccggccgggttctgccacagcttcccacgtgcttgctgacatgcgtgtgcctgtgtgtggtgtctgttgctgtgtcgtgaaactgtgaccatcactcagtccaaacaagtgagtggccctcgaggccacagttatgcaactttcagtgtgtgtcataacgacgtcactgctttttaaactcgataactctttattttagtaaaatgcccaggagtcctggaagctacgcggacttgcagaggttttattttttggccttagaatctgcagaaattaggaggcaccgagcccagcgcagcagcctcggacccggattgcgtttgccttagcggatatgtttatacagatgaatataaaatgtttttttctttgggctttttgcttcttttttcccccccttctcaccttcccttctccccgaccccaccccccaaaaaagctacttcttcattccgtggtacgattattttttttaactaaaggaagataaaattct

SEQ ID NO: 2041 - DNA, 2419 bp, Homo sapiens
aggaagaggaagagcgcggccggcggcgctgcgctgagagcaggggcccggccaaggcgagtgccgcgcgggccaccatggccacggacgagctggccaccaagctgagccggcggctgcagatggagggcgagggcggcggcgagaccccggagcagcccgggctgaacggggcagcggcggcggcggcgggggcacccgacgaggcggccgaggcgctgggcagcgcggactgcgagctgagcgccaagctgctgcggcgcgcagacctcaaccagggcatcggcgagccccagtcgcccagccgccgcgtcttcaacccctacaccgagttcaaggagttctccaggaagcagatcaaggacatggagaagatgttcaagcagtatgatgccgggcgggacggcttcatcgacctgatggagctaaaactcatgatggagaaacttggggcccctcagacccacctgggcctgaaaaacatgatcaaggaggtggatgaggactttgacagcaagctgagcttccgggagttcctcctgatcttccgcaaggcggcggccggggagcttcaggaggacagcgggctgtgcgtgctggcccgcctctctgagatcgacgtctccagtgagggtgtcaagggggccaagagcttctttgaggccaaggtccaggccatcaacgtgtccagccgcttcgaggaggagatcaaggcagagcaggaggaaaggaagaagcaggcggaggagatgaagcagcggaaagcggccttcaaggagctgcagtccacctttaagtagcgggggctgcagccgaccgccctgctccggccccagtgtggtgggcgagggtggcgcatgggaggccgagcctgaatccttgcctgtgtctgacgggaccactactaaaaacctaaaaatatctgtgaatggagcaagttcaggggtcttatggaggtggcccggcccctccccgctcccttccactctgcacgaggccgccacaccggcgctggctccctgcccggcccggccctccctggcaatccctgggctctcttgcacccctaactgccccctgcctgctccggcactgccccaggcccagctcctggccctaggtccctcccagccccatgtgcctgccgcctgccctccacacatccctgtccccccaacccgggaacccctgccctcctccagcaggccgcaccgcccctggggccccctgccagccccttcccaggctgggagacggcagaagagatagaatcagggctgcccccacagagtgggacccaaggggctaattggaggcacgaggggacccctccccagggccttttcctcctctgcgtcttccatctactgaaatgggagagggggtggggagcttctgttctggtgaagggacccgggcaggcccccagcaccccatgctgacttggagaaccccagatctctggggcccagccaggcagggtgtgggggcagctgtgccaatctacctcacaggcccaccccctgccgggcatgccgtgggatcatgggcagggaaggctctgggggtcggagacaccgctgcttagcacccccagccagaacaccctgagggtctcggggctctggagagagtggggcgggaggaagaattggcaccttcctagggaaggagacgagcgcttcgccttgattctccgagaagcctccgagaagtgctttaagtgtgtttgcatgcgccaggcggtgggcagcgggggcctgtccagccctctcccgccatccttccccaagtgacgtccactgccttgtcaccagcgacctgcctgtcatgcccaccccctgaggaagcatggggaccctaacaccctggtgccctgcaccagacaggccgtggtcaggcccaggccaccggccgggttctgccacagcttcccacgtgcttgctgacatgcgtgtgcctgtgtgtggtgtctgttgctgtgtcgtgaaactgtgaccatcactcagtccaaacaagtgagtggccctcgaggccacagttatgcaactttcagtgtgtgtcataacgacgtcactgctttttaaactcgataactctttattttagtaaaatgcccaggagtcctggaagctacgcggacttgcagaggttttattttttggccttagaatctgcagaaattaggaggcaccgagcccagcgcagcagcctcggacccggattgcgtttgccttagcggatatgtttatacagatgaatataaaatgtttttttctttgggctttttgcttcttttttcccccccttctcaccttcccttctccccgaccccaccccccaaaaaagctacttcttcattccgtggtacgattattttttttaactaaaggaagataaaattctatattcttatgtg

SEQ ID NO: 2042 - DNA, 899 bp, Homo sapiens
gaagatgttcaagcagtatgatgccgggcgggacggcttcatcgacctgatggagctaaaactcatgatggagaaacttggggcccctcagacccacctgggcctgaaaaacatgatcaaggaggtggatgaggactttgacagcaagctgagcttccgggagttcctcctgatcttccgcaaggcggcggccggggagcttcaggaggacagcgggctgtgcgtgctggcccgcctctctgagatcgacgtctccagtgagggtgtcaagggggccaagagcttctttgaggccaagtggaactgggtgtgccgctgggctccccggacaggaagcagaggatcaggatggcagcagcttgagcgactcccttcgagcgcccttgctttgcagcagccacagaatataggtccaggccatcaacgtgtccagccgcttcgaggaggagatcaaggcagagcaggaggaaaggaagaagcaggcggaggagatgaagcagcggaaagcggccttcaaggagctgcagtccacctttaagtagcgggggctgcagccgaccgccctgctccggccccagtgtggtgggcgagggtggcgcatgggaggccgagcctgaatccttgcctgtgtctgacgggaccactactaaaaacctaaaaatatctgtgaatggagcaagttcaggggtcttatggaggtggcccggcccctccccgctcccttccactctgcacgaggccgccacaccggcgctggctccctgcccggcccggccctccctggcaatccctgggctctcttgcacccctaactgccccctgcctgctccggcactgccccaggcccagctcctggccctaggtccctcccagccccatgtgcctgccgcctgccctcc

SEQ ID NO: 2043 - DNA, 3527 bp, Homo sapiens
cgggtccacagccgcactcactccgccgcgctctccgccaccgccaccactgcggccaccgccaatgaaacgcctcccgctcctagtggttttttccactttgttgaattgttcctatactcaaaattgcaccaagacaccttgtctcccaaatgcaaaatgtgaaatacgcaatggaattgaagcctgctattgcaacatgggattttcaggaaatggtgtcacaatttgtgaagatgataatgaatgtggaaatttaactcagtcctgtggcgaaaatgctaattgcactaacacagaaggaagttattattgtatgtgtgtacctggcttcagatccagcagtaaccaagacaggtttatcactaatgatggaaccgtctgtatagaaaatgtgaatgcaaactgccatttagataatgtctgtatagctgcaaatattaataaaactttaacaaaaatcagatccataaaagaacctgtggctttgctacaagaagtctatagaaattctgtgacagatctttcaccaacagatataattacatatatagaaatattagctgaatcatcttcattactaggttacaagaacaacactatctcagccaaggacaccctttctaactcaactcttactgaatttgtaaaaaccgtgaataattttgttcaaagggatacatttgtagtttgggacaagttatctgtgaatcataggagaacacatcttacaaaactcatgcacactgttgaacaagctactttaaggatatcccagagcttccaaaagaccacagagtttgatacaaattcaacggatatagctctcaaagttttcttttttgattcatataacatgaaacatattcatcctcatatgaatatggatggagactacataaatatatttccaaagagaaaagctgcatatgattcaaatggcaatgttgcagttgcatttgtatattataagagtattggtcctttgctttcatcatctgacaacttcttattgaaacctcaaaattatgataattctgaagaggaggaaagagtcatatcttcagtaatttcagtctcaatgagctcaaacccacccacattatatgaacttgaaaaaataacatttacattaagtcatcgaaaggtcacagataggtataggagtctatgtgcattttggaattactcacctgataccatgaatggcagctggtcttcagagggctgtgagctgacatactcaaatgagacccacacctcatgccgctgtaatcacctgacacattttgcaattttgatgtcctctggtccttccattggtattaaagattataatattcttacaaggatcactcaactaggaataattatttcactgatttgtcttgccatatgcatttttaccttctggttcttcagtgaaattcaaagcaccaggacaacaattcacaaaaatctttgctgtagcctatttcttgctgaacttgtttttcttgttgggatcaatacaaatactaataagctcttctgttcaatcattgccggactgctacactacttctttttagctgcttttgcatggatgtgcattgaaggcatacatctctatctcattgttgtgggtgtcatctacaacaagggatttttgcacaagaatttttatatctttggctatctaagcccagccgtggtagttggattttcggcagcactaggatacagatattatggcacaaccaaagtatgttggcttagcaccgaaaacaactttatttggagttttataggaccagcatgcctaatcattcttgttaatctcttggcttttggagtcatcatatacaaagtttttcgtcacactgcagggttgaaaccagaagttagttgctttgagaacataaggtcttgtgcaagaggagccctcgctcttctgttccttctcggcaccacctggatctttggggttctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaaggtaaacatagagaatggtggataattacaactgcacaaaaataaaaattccaagctgtggatgaccaatgtataaaaatgactcatcaaattatccaattattaactactagacaaaaagtattttaaatcagtttttctgtttatgctataggaactgtagataataaggtaaaattatgtatcatatagatatactatgtttttctatgtgaaatagttctgtcaaaaatagtattgcagatatttggaaagtaattggtttctcaggagtgatatcactgcacccaaggaaagattttctttctaacacgagaagtatatgaatgtcctgaaggaaaccactggcttgatatttctgtgactcgtgttgcctttgaaactagtcccctaccacctcggtaatgagctccattacagaaagtggaacataagagaatgaaggggcagaatatcaaacagtgaaaagggaatgataagatgtattttgaatgaactgttttttctgtagactagctgagaaattgttgacataaaataaagaattgaagaaacacattttaccattttgtgaattgttctgaacttaaatgtccactaaaacaacttagacttctgtttgctaaatctgtttctttttctaatattctaaaaaaaaaaaaaaggtttacctccacaaattgaaaaaaaaaaagtgaaaaaaatctgtttctaaggttagactgagatatatactatttccttacttatttcacagattgtgactttggatagttaatcagtaaaatataaatgtgtcaagatataatattgtttatacctatcaatgtaaaaacagtgtaataaagctgaagtattctattacctttcagtgaagtgaaagttatactatctcattagtatatttgaatcctttattatttttaattttataaatatcacagttcacattgcaatattccctttaatttactatttttaaaggggtattgtaaatatgaaagtatttataaagtgaattgctattttttctgttcagaaaagtacacacttaaaattgttattgttaacaatgtgtaaacacatttaaaattgttattgttaacaaagaaatcatggagaactgtagaggttttcacagtggatccattttctgacagttttctactatctattaaatcatatctgcttaaatatatagcttctatctgtctttaaatcttctcattaaaatgtataagcagtgattttgatctcaaaaataggtaatttttctttgccgacctgtaaaagtgtgccaatacactaaatttgtgattttaaattaattcctccagctgttgaaatgaagtctgccaaatcttgctctaacaaataaaatgttatctaaatgaa

SEQ ID NO: 2044 - DNA, 501 bp, Homo sapiens
gtggtagttggattttcggcagcactaggatacagatattatggcacaaccaaagtatgttggcttagcaccgaaaacaactttatttggagttttataggaccagcatgcctaatcattcttgttaatctcttggcttttggagtcatcatatacaaagtttttcgtcacactgcagggttgaaaccagaagttagttgctttgagaacataaggtcttgtgcaagaggagccctcgctcttctgttccttctcggcaccacctggatctttggggttctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaagctgttgaaatgaagtctgccaaatcttgctctaacaaataaaatgttatctaaatgaa

SEQ ID NO: 2045 - DNA, 3081 bp, Homo sapiens
ggtctgctctgtgcggtgaagcttctcttcttggcacctgcctggcatcggaagagggccccttctccctccctgggcttttatgtggacactgtaatgcctcagttttctttctttctttttgtttttgacacagggtctcactctatcacccaagctggagtgcagtggcaccatcttagctcaccgcagcctcaaactccccagctcgggtgattcttcctgcctcagcctcctgagtagtagcagctgggaccacagacgtctgccaccaagcccagctgcaccgccagttccggggagggccctgggccagcggctgtccgccccccctcctttataaagtcctggcctcgggacagcccgcacagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtgaatgaatgcacctccggacaaaacccatgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccaggcccttctgtggtgggccttgtctccattccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgttcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaaggatgttatggaaggcgtgctaggcatt

SEQ ID NO: 2046 - DNA, 6771 bp, Homo sapiens
ggggggtctgctctgtgcggtgaagcttctcttcttggcacctgcctggcatcggaagagggccccttctccctccctgggcttttatgtggacactgtaatgcctcagttttctttctttctttttgtttttgacacagggtctcactctatcacccaagctggagtgcagtggcaccatcttagctcaccgcagcctcaaactccccagctcgggtgattcttcctgcctcagcctcctgagtagtagcagctgggaccacagacgtctgccaccaagcccagctgcaccgccagttccggggagggccctgggccagcggctgtccgccccccctcctttataaagtcctggcctcgggacagcccgcacagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtgaatgaatgcacctccggacaaaacccatgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccaggcccttctgtggtgggccttgtctccattccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgttcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaaggatgttatggaaggcgtgctaggcattcaattcctgcagaaaccggaaatcttccatgccctgcaatgtgctcatcaaactctcagcatatggacggccagctgtggcccatatcttggtcactctgaagcacaatatttatgaagctatagaacgttaagacctctttcacagcctctccttcctacaaagactcctccaaatcttaaaatgaagcaggaaaacgagcctaagaggactttcataccgacaacatctgaaaggactagaatgttcacaccacgatctggatttcttaattttttgtttttgtttttgttgttctctagttctacgggtttgattatttagtcatgtgaaaaatattgattactcacacatagatcaagagagacacggctcctgccttcatggagcttttaggggaaaatgaagtggctcttgcagctagagttgactcagaagccgaaattcctagaaatcaggtttctactgctaggcaattgaagtataaactattttataaacactgtcttctttcgtcttcacaccaacatgcagaaaagtttctaatctcagatcggggatgtgcaacaaattccatttcaaaggaatgacctgcaaaactcctaaatattccaagcaaatgcccttaaccctgtctgttatctgctttccttgaacagaaattctacatgaccataaaacctcgaagatgggtatggcacagttcatgccctgtaatcctagcactttgggagggtgaggcaggaggatggctcaagcccaggagtttgagaccagtgtgggcaacagagtgagaaccatctctacccaaaaaaaaaattaaaaattagccaagcatggtgatgatataggagttaaggagaaatcatttaggcaaatagcaagggtaggaagtcctcagtaaggttttccatttaatgaaaagcagcccccaaaatcattttcttttctaacaaagaacagcctgtaaaatcgagctgcagacatagacaagcaagctggaagcttccacgggtgaatgccggcagctgtgccaataggaaaaagctacctagactaggcatgtccaaaatggcggctccaagttcccttctctttgccagccatgtgtacagtaaaaagcaggcaacatagtgtcagccaaagctcatttgcataataagattagggtggggtggccagctcacataggggtaggccctaggtaaatcagacaccgccttctcaagcctgtctataaaatctggtacactatgacgagggtcagatttcccattcagacgcccctctcccatgcaagagaaagagctgttctcctttctctttcttttgcctattaaacctctgctcctggccaggcacagtggctcacgcctataatcccagcactttgggaggctgaggtggtcagatcacctaaggtcaggagttcaagaccagcctggtcaacatggtgaaatcttgtctctagtaaaaatacaaaaatatatgaaatctcacatagatgataatattaagttccaaaagcaactcaacctggtagattctaattttttttgaggcagggtcttgctttgtcacccatgctggagtacaatggcacaaacactgctcactgcagcctcgacctcccaaggcctaagcaatcctcctgcctcagtccccctccaggtatttgaaactacaggtgtgtaccaccacaccgggctaatttttgtattttttgtagagacgtgggtctcactatgctgcccaggctcaggtcttaatctcctgagctcaggcaatccgcaggcctcagcctccctaagtgcggggattacaggcttgagccactgcacctagcctctatttgttttacaaaagagaaattgagatcctgaatgttaagtgacttgcctgaggccatcccactaacaggagccagggttaggattcaaaccccatccaactggtcccagagctggagcttcttgcactgccctacactacctaccatctccatcctctgggcacctttttataagaaccaaaacattacagagcattgctttgtcaactcagctgggaacatttcccagtgcaactcacatttttcactgctctgtgcctgtccgtataagctcaatgagtattgatttaggggctttggagaactttgaatgctaccccccaagtaaccattgttggcaacctggtacctctacttttagccatttctccttctctataaatagtgcagaagtaacccacttggtaacaggcatccttgccaagcctccaccactaggtcagtgtaagaattaaagaaagaggaaagaaacacaaaaagtggcttgatggttaagacaggtttattttagagaaaacacacctgagaggggctgctggctgaattaggttagagtcttttctacagactaagagtgtttaaggatttagggtgggagagtttcttagaggcttggactgcttctgtgttttttttgttgtgcttatatgggagggagagtggtgtgtttgcttttatacatttttctgcagctgtaggcataccccccaagtctgcttttagcttccctattttagtgcacctggagggaaaggaatgtgcttattaaggcccactgttttactggggcccattgtatgagggtgaagtttggcagttacccaagagacttttcctccaccttcctctgtgcccgagctgttttatctgcattttactgtctgctttttttggctgcttatagtttttaaaaaagtaatttccttaaatccagaaggctaaaaatgaagctgaaacttaaagtggcggtgtttgtccaaaataacggggctcctgctctgccagtcagtaccctcaagtcactcctgatcctcaacctccatgcctaaggctggttcaagagaccacataatatctgccttttattacatacatgatgggtgcatgggattctgcgtgccctttgcttgatatagactgctaaggtgagatggggaatatcagagtcagctgctgcttgaggaagcagaacacacagctggaggcttggaacatgtgggtccctatgagtgtagagcccatatccccatagagtctacctagagcaggggtcgccaaatgttttcttaaagagcctgatagtgtatatgttaggctttgtgagccaggtatttacagcaactcaattctaccactgtggtatgaaaacagctatagacaatcataaatgaatgatcatggctatgttttaataaaactttacagacactgaacttgaacttccattgtgatatgaaaacagctatagacaatcataaatgaatgatcatggctatgttttaataaaactttatggacactgagcttgaacttcatatatcagtcatgtgacacaaaatatcattcttctttttatttgttttcacccatttgaaaaatgtaaaaactattcttagctgtacagaaacagatggtgggtcagatttgactcactgcccatagtttccagaccatgatgttcaggttcatggaagcacttcactctacactaatttattcatccattcatcacatatgtgatgagcacatacagacacacctcagagatattgcaggctccactccagatcaccacaataatgtgaatattgcaataaagcaagtcatacacatt

SEQ ID NO: 2047 - DNA, 6624 bp, Homo sapiens
ggggggtctgctctgtgcggtgaagcttctcttcttggcacctgcctggcatcggaagagggccccttctccctccctgggcttttatgtggacactgtaatgcctcagttttctttctttctttttgtttttgacacagggtctcactctatcacccaagctggagtgcagtggcaccatcttagctcaccgcagcctcaaactccccagctcgggtgattcttcctgcctcagcctcctgagtagtagcagctgggaccacagacgtctgccaccaagcccagctgcaccgccagttccggggagggccctgggccagcggctgtccgccccccctcctttataaagtcctggcctcgggacagcccgcacagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccaggcccttctgtggtgggccttgtctccattccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgttcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaaggatgttatggaaggcgtgctaggcattcaattcctgcagaaaccggaaatcttccatgccctgcaatgtgctcatcaaactctcagcatatggacggccagctgtggcccatatcttggtcactctgaagcacaatatttatgaagctatagaacgttaagacctctttcacagcctctccttcctacaaagactcctccaaatcttaaaatgaagcaggaaaacgagcctaagaggactttcataccgacaacatctgaaaggactagaatgttcacaccacgatctggatttcttaattttttgtttttgtttttgttgttctctagttctacgggtttgattatttagtcatgtgaaaaatattgattactcacacatagatcaagagagacacggctcctgccttcatggagcttttaggggaaaatgaagtggctcttgcagctagagttgactcagaagccgaaattcctagaaatcaggtttctactgctaggcaattgaagtataaactattttataaacactgtcttctttcgtcttcacaccaacatgcagaaaagtttctaatctcagatcggggatgtgcaacaaattccatttcaaaggaatgacctgcaaaactcctaaatattccaagcaaatgcccttaaccctgtctgttatctgctttccttgaacagaaattctacatgaccataaaacctcgaagatgggtatggcacagttcatgccctgtaatcctagcactttgggagggtgaggcaggaggatggctcaagcccaggagtttgagaccagtgtgggcaacagagtgagaaccatctctacccaaaaaaaaaattaaaaattagccaagcatggtgatgatataggagttaaggagaaatcatttaggcaaatagcaagggtaggaagtcctcagtaaggttttccatttaatgaaaagcagcccccaaaatcattttcttttctaacaaagaacagcctgtaaaatcgagctgcagacatagacaagcaagctggaagcttccacgggtgaatgccggcagctgtgccaataggaaaaagctacctagactaggcatgtccaaaatggcggctccaagttcccttctctttgccagccatgtgtacagtaaaaagcaggcaacatagtgtcagccaaagctcatttgcataataagattagggtggggtggccagctcacataggggtaggccctaggtaaatcagacaccgccttctcaagcctgtctataaaatctggtacactatgacgagggtcagatttcccattcagacgcccctctcccatgcaagagaaagagctgttctcctttctctttcttttgcctattaaacctctgctcctggccaggcacagtggctcacgcctataatcccagcactttgggaggctgaggtggtcagatcacctaaggtcaggagttcaagaccagcctggtcaacatggtgaaatcttgtctctagtaaaaatacaaaaatatatgaaatctcacatagatgataatattaagttccaaaagcaactcaacctggtagattctaattttttttgaggcagggtcttgctttgtcacccatgctggagtacaatggcacaaacactgctcactgcagcctcgacctcccaaggcctaagcaatcctcctgcctcagtccccctccaggtatttgaaactacaggtgtgtaccaccacaccgggctaatttttgtattttttgtagagacgtgggtctcactatgctgcccaggctcaggtcttaatctcctgagctcaggcaatccgcaggcctcagcctccctaagtgcggggattacaggcttgagccactgcacctagcctctatttgttttacaaaagagaaattgagatcctgaatgttaagtgacttgcctgaggccatcccactaacaggagccagggttaggattcaaaccccatccaactggtcccagagctggagcttcttgcactgccctacactacctaccatctccatcctctgggcacctttttataagaaccaaaacattacagagcattgctttgtcaactcagctgggaacatttcccagtgcaactcacatttttcactgctctgtgcctgtccgtataagctcaatgagtattgatttaggggctttggagaactttgaatgctaccccccaagtaaccattgttggcaacctggtacctctacttttagccatttctccttctctataaatagtgcagaagtaacccacttggtaacaggcatccttgccaagcctccaccactaggtcagtgtaagaattaaagaaagaggaaagaaacacaaaaagtggcttgatggttaagacaggtttattttagagaaaacacacctgagaggggctgctggctgaattaggttagagtcttttctacagactaagagtgtttaaggatttagggtgggagagtttcttagaggcttggactgcttctgtgttttttttgttgtgcttatatgggagggagagtggtgtgtttgcttttatacatttttctgcagctgtaggcataccccccaagtctgcttttagcttccctattttagtgcacctggagggaaaggaatgtgcttattaaggcccactgttttactggggcccattgtatgagggtgaagtttggcagttacccaagagacttttcctccaccttcctctgtgcccgagctgttttatctgcattttactgtctgctttttttggctgcttatagtttttaaaaaagtaatttccttaaatccagaaggctaaaaatgaagctgaaacttaaagtggcggtgtttgtccaaaataacggggctcctgctctgccagtcagtaccctcaagtcactcctgatcctcaacctccatgcctaaggctggttcaagagaccacataatatctgccttttattacatacatgatgggtgcatgggattctgcgtgccctttgcttgatatagactgctaaggtgagatggggaatatcagagtcagctgctgcttgaggaagcagaacacacagctggaggcttggaacatgtgggtccctatgagtgtagagcccatatccccatagagtctacctagagcaggggtcgccaaatgttttcttaaagagcctgatagtgtatatgttaggctttgtgagccaggtatttacagcaactcaattctaccactgtggtatgaaaacagctatagacaatcataaatgaatgatcatggctatgttttaataaaactttacagacactgaacttgaacttccattgtgatatgaaaacagctatagacaatcataaatgaatgatcatggctatgttttaataaaactttatggacactgagcttgaacttcatatatcagtcatgtgacacaaaatatcattcttctttttatttgttttcacccatttgaaaaatgtaaaaactattcttagctgtacagaaacagatggtgggtcagatttgactcactgcccatagtttccagaccatgatgttcaggttcatggaagcacttcactctacactaatttattcatccattcatcacatatgtgatgagcacatacagacacacctcagagatattgcaggctccactccagatcaccacaataatgtgaatattgcaataaagcaagtcatacacatt

SEQ ID NO: 2048 - DNA, 6345 bp, Homo sapiens
ggggggtctgctctgtgcggtgaagcttctcttcttggcacctgcctggcatcggaagagggccccttctccctccctgggcttttatgtggacactgtaatgcctcagttttctttctttctttttgtttttgacacagggtctcactctatcacccaagctggagtgcagtggcaccatcttagctcaccgcagcctcaaactccccagctcgggtgattcttcctgcctcagcctcctgagtagtagcagctgggaccacagacgtctgccaccaagcccagctgcaccgccagttccggggagggccctgggccagcggctgtccgccccccctcctttataaagtcctggcctcgggacagcccgcacagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccaggcccttctgtggtgggccttgtctccattccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgttcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaaggatgttatggaaggcgtgctaggcattcaattcctgcagaaaccggaaatcttccatgccctgcaatgtgctcatcaaactctcagcatatggacggccagctgtggcccatatcttggtcactctgaagcacaatatttatgaagctatagaacgttaagacctctttcacagcctctccttcctacaaagactcctccaaatcttaaaatgaagcaggaaaacgagcctaagaggactttcataccgacaacatctgaaaggactagaatgttcacaccacgatctggatttcttaattttttgtttttgtttttgttgttctctagttctacgggtttgattatttagtcatgtgaaaaatattgattactcacacatagatcaagagagacacggctcctgccttcatggagcttttaggggaaaatgaagtggctcttgcagctagagttgactcagaagccgaaattcctagaaatcaggtttctactgctaggcaattgaagtataaactattttataaacactgtcttctttcgtcttcacaccaacatgcagaaaagtttctaatctcagatcggggatgtgcaacaaattccatttcaaaggaatgacctgcaaaactcctaaatattccaagcaaatgcccttaaccctgtctgttatctgctttccttgaacagaaattctacatgaccataaaacctcgaagatgggtatggcacagttcatgccctgtaatcctagcactttgggagggtgaggcaggaggatggctcaagcccaggagtttgagaccagtgtgggcaacagagtgagaaccatctctacccaaaaaaaaaattaaaaattagccaagcatggtgatgatataggagttaaggagaaatcatttaggcaaatagcaagggtaggaagtcctcagtaaggttttccatttaatgaaaagcagcccccaaaatcattttcttttctaacaaagaacagcctgtaaaatcgagctgcagacatagacaagcaagctggaagcttccacgggtgaatgccggcagctgtgccaataggaaaaagctacctagactaggcatgtccaaaatggcggctccaagttcccttctctttgccagccatgtgtacagtaaaaagcaggcaacatagtgtcagccaaagctcatttgcataataagattagggtggggtggccagctcacataggggtaggccctaggtaaatcagacaccgccttctcaagcctgtctataaaatctggtacactatgacgagggtcagatttcccattcagacgcccctctcccatgcaagagaaagagctgttctcctttctctttcttttgcctattaaacctctgctcctggccaggcacagtggctcacgcctataatcccagcactttgggaggctgaggtggtcagatcacctaaggtcaggagttcaagaccagcctggtcaacatggtgaaatcttgtctctagtaaaaatacaaaaatatatgaaatctcacatagatgataatattaagttccaaaagcaactcaacctggtagattctaattttttttgaggcagggtcttgctttgtcacccatgctggagtacaatggcacaaacactgctcactgcagcctcgacctcccaaggcctaagcaatcctcctgcctcagtccccctccaggtatttgaaactacaggtgtgtaccaccacaccgggctaatttttgtattttttgtagagacgtgggtctcactatgctgcccaggctcaggtcttaatctcctgagctcaggcaatccgcaggcctcagcctccctaagtgcggggattacaggcttgagccactgcacctagcctctatttgttttacaaaagagaaattgagatcctgaatgttaagtgacttgcctgaggccatcccactaacaggagccagggttaggattcaaaccccatccaactggtcccagagctggagcttcttgcactgccctacactacctaccatctccatcctctgggcacctttttataagaaccaaaacattacagagcattgctttgtcaactcagctgggaacatttcccagtgcaactcacatttttcactgctctgtgcctgtccgtataagctcaatgagtattgatttaggggctttggagaactttgaatgctaccccccaagtaaccattgttggcaacctggtacctctacttttagccatttctccttctctataaatagtgcagaagtaacccacttggtaacaggcatccttgccaagcctccaccactaggtcagtgtaagaattaaagaaagaggaaagaaacacaaaaagtggcttgatggttaagacaggtttattttagagaaaacacacctgagaggggctgctggctgaattaggttagagtcttttctacagactaagagtgtttaaggatttagggtgggagagtttcttagaggcttggactgcttctgtgttttttttgttgtgcttatatgggagggagagtggtgtgtttgcttttatacatttttctgcagctgtaggcataccccccaagtctgcttttagcttccctattttagtgcacctggagggaaaggaatgtgcttattaaggcccactgttttactggggcccattgtatgagggtgaagtttggcagttacccaagagacttttcctccaccttcctctgtgcccgagctgttttatctgcattttactgtctgctttttttggctgcttatagtttttaaaaaagtaatttccttaaatccagaaggctaaaaatgaagctgaaacttaaagtggcggtgtttgtccaaaataacggggctcctgctctgccagtcagtaccctcaagtcactcctgatcctcaacctccatgcctaaggctggttcaagagaccacataatatctgccttttattacatacatgatgggtgcatgggattctgcgtgccctttgcttgatatagactgctaaggtgagatggggaatatcagagtcagctgctgcttgaggaagcagaacacacagctggaggcttggaacatgtgggtccctatgagtgtagagcccatatccccatagagtctacctagagcaggggtcgccaaatgttttcttaaagagcctgatagtgtatatgttaggctttgtgagccaggtatttacagcaactcaattctaccactgtggtatgaaaacagctatagacaatcataaatgaatgatcatggctatgttttaataaaactttacagacactgaacttgaacttccattgtgatatgaaaacagctatagacaatcataaatgaatgatcatggctatgttttaataaaactttatggacactgagcttgaacttcatatatcagtcatgtgacacaaaatatcattcttctttttatttgttttcacccatttgaaaaatgtaaaaactattcttagctgtacagaaacagatggtgggtcagatttgactcactgcccatagtttccagaccatgatgttcaggttcatggaagcacttcactctacactaatttattcatccattcatcacatatgtgatgagcacatacagacacacctcagagatattgcaggctccactccagatcaccacaataatgtgaatattgcaataaagcaagtcatacacatt

SEQ ID NO: 2049 - DNA, 6492 bp, Homo sapiens
ggggggtctgctctgtgcggtgaagcttctcttcttggcacctgcctggcatcggaagagggccccttctccctccctgggcttttatgtggacactgtaatgcctcagttttctttctttctttttgtttttgacacagggtctcactctatcacccaagctggagtgcagtggcaccatcttagctcaccgcagcctcaaactccccagctcgggtgattcttcctgcctcagcctcctgagtagtagcagctgggaccacagacgtctgccaccaagcccagctgcaccgccagttccggggagggccctgggccagcggctgtccgccccccctcctttataaagtcctggcctcgggacagcccgcacagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccaggcccttctgtggtgggccttgtctccattccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgttcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaaggatgttatggaaggcgtgctaggcattcaattcctgcagaaaccggaaatcttccatgccctgcaatgtgctcatcaaactctcagcatatggacggccagctgtggcccatatcttggtcactctgaagcacaatatttatgaagctatagaacgttaagacctctttcacagcctctccttcctacaaagactcctccaaatcttaaaatgaagcaggaaaacgagcctaagaggactttcataccgacaacatctgaaaggactagaatgttcacaccacgatctggatttcttaattttttgtttttgtttttgttgttctctagttctacgggtttgattatttagtcatgtgaaaaatattgattactcacacatagatcaagagagacacggctcctgccttcatggagcttttaggggaaaatgaagtggctcttgcagctagagttgactcagaagccgaaattcctagaaatcaggtttctactgctaggcaattgaagtataaactattttataaacactgtcttctttcgtcttcacaccaacatgcagaaaagtttctaatctcagatcggggatgtgcaacaaattccatttcaaaggaatgacctgcaaaactcctaaatattccaagcaaatgcccttaaccctgtctgttatctgctttccttgaacagaaattctacatgaccataaaacctcgaagatgggtatggcacagttcatgccctgtaatcctagcactttgggagggtgaggcaggaggatggctcaagcccaggagtttgagaccagtgtgggcaacagagtgagaaccatctctacccaaaaaaaaaattaaaaattagccaagcatggtgatgatataggagttaaggagaaatcatttaggcaaatagcaagggtaggaagtcctcagtaaggttttccatttaatgaaaagcagcccccaaaatcattttcttttctaacaaagaacagcctgtaaaatcgagctgcagacatagacaagcaagctggaagcttccacgggtgaatgccggcagctgtgccaataggaaaaagctacctagactaggcatgtccaaaatggcggctccaagttcccttctctttgccagccatgtgtacagtaaaaagcaggcaacatagtgtcagccaaagctcatttgcataataagattagggtggggtggccagctcacataggggtaggccctaggtaaatcagacaccgccttctcaagcctgtctataaaatctggtacactatgacgagggtcagatttcccattcagacgcccctctcccatgcaagagaaagagctgttctcctttctctttcttttgcctattaaacctctgctcctggccaggcacagtggctcacgcctataatcccagcactttgggaggctgaggtggtcagatcacctaaggtcaggagttcaagaccagcctggtcaacatggtgaaatcttgtctctagtaaaaatacaaaaatatatgaaatctcacatagatgataatattaagttccaaaagcaactcaacctggtagattctaattttttttgaggcagggtcttgctttgtcacccatgctggagtacaatggcacaaacactgctcactgcagcctcgacctcccaaggcctaagcaatcctcctgcctcagtccccctccaggtatttgaaactacaggtgtgtaccaccacaccgggctaatttttgtattttttgtagagacgtgggtctcactatgctgcccaggctcaggtcttaatctcctgagctcaggcaatccgcaggcctcagcctccctaagtgcggggattacaggcttgagccactgcacctagcctctatttgttttacaaaagagaaattgagatcctgaatgttaagtgacttgcctgaggccatcccactaacaggagccagggttaggattcaaaccccatccaactggtcccagagctggagcttcttgcactgccctacactacctaccatctccatcctctgggcacctttttataagaaccaaaacattacagagcattgctttgtcaactcagctgggaacatttcccagtgcaactcacatttttcactgctctgtgcctgtccgtataagctcaatgagtattgatttaggggctttggagaactttgaatgctaccccccaagtaaccattgttggcaacctggtacctctacttttagccatttctccttctctataaatagtgcagaagtaacccacttggtaacaggcatccttgccaagcctccaccactaggtcagtgtaagaattaaagaaagaggaaagaaacacaaaaagtggcttgatggttaagacaggtttattttagagaaaacacacctgagaggggctgctggctgaattaggttagagtcttttctacagactaagagtgtttaaggatttagggtgggagagtttcttagaggcttggactgcttctgtgttttttttgttgtgcttatatgggagggagagtggtgtgtttgcttttatacatttttctgcagctgtaggcataccccccaagtctgcttttagcttccctattttagtgcacctggagggaaaggaatgtgcttattaaggcccactgttttactggggcccattgtatgagggtgaagtttggcagttacccaagagacttttcctccaccttcctctgtgcccgagctgttttatctgcattttactgtctgctttttttggctgcttatagtttttaaaaaagtaatttccttaaatccagaaggctaaaaatgaagctgaaacttaaagtggcggtgtttgtccaaaataacggggctcctgctctgccagtcagtaccctcaagtcactcctgatcctcaacctccatgcctaaggctggttcaagagaccacataatatctgccttttattacatacatgatgggtgcatgggattctgcgtgccctttgcttgatatagactgctaaggtgagatggggaatatcagagtcagctgctgcttgaggaagcagaacacacagctggaggcttggaacatgtgggtccctatgagtgtagagcccatatccccatagagtctacctagagcaggggtcgccaaatgttttcttaaagagcctgatagtgtatatgttaggctttgtgagccaggtatttacagcaactcaattctaccactgtggtatgaaaacagctatagacaatcataaatgaatgatcatggctatgttttaataaaactttacagacactgaacttgaacttccattgtgatatgaaaacagctatagacaatcataaatgaatgatcatggctatgttttaataaaactttatggacactgagcttgaacttcatatatcagtcatgtgacacaaaatatcattcttctttttatttgttttcacccatttgaaaaatgtaaaaactattcttagctgtacagaaacagatggtgggtcagatttgactcactgcccatagtttccagaccatgatgttcaggttcatggaagcacttcactctacactaatttattcatccattcatcacatatgtgatgagcacatacagacacacctcagagatattgcaggctccactccagatcaccacaataatgtgaatattgcaataaagcaagtcatacacatt

SEQ ID NO: 2050 - DNA, 3328 bp, Homo sapiens
ggggtctgctctgtgcggtgaagcttctcttcttggcacctgcctggcatcggaagagggccccttctccctccctgggcttttatgtggacactgtaatgcctcagttttctttctttctttttgtttttgacacagggtctcactctatcacccaagctggagtgcagtggcaccatcttagctcaccgcagcctcaaactccccagctcgggtgattcttcctgcctcagcctcctgagtagtagcagctgggaccacagacgtctgccaccaagcccagctgcaccgccagttccggggagggccctgggccagcggctgtccgccccccctcctttataaagtcctggcctcgggacagcccgcacagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtgaatgaatgcacctccggacaaaacccatgccacagctccacccactgcctcaacaacgtgggcagctatcagtgccgctgccgcccgggctggcaaccgattccggggtcccccaatggcccaaacaataccgtctgtgaaggtcgagagctcagatcccacgttcccagagacccacaaacatctgatcacatgttcaacggcgcccacacaaaccaagcagaatgagcgctggaggcgcccgactgtgtcaggcgttcattcttctgaggctagatgagaaaagagcaagggtcctgcggaaggagctggggtactgaggggggaggctcagggggaccccaggcaacagctgatgactcactgggaggaaggcgtttcaccatattcataacctgctcatctgcacggggcccacctgctgtgcccaggcctctccacgcttccataacccagcgtccacctctccaaggggggcactaatgccgggaggaacgagctgggggcacagacaggagacaggaccctctccaggctgggacaggacctgacccccttcttcctgtcctcagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaaggatgttatggaaggcgtgctaggcattcaattcctgcagaaaccggaaatcttccatgccctgcaatgtgctcatcaaactctcagcatatggacggccagctgtggcccatatcttggtcactctgaagcacaatatttatgaagctatagaacgttaagacctctttcacagcctctccttcctacaaagactcctccaaatcttaaaatgaagcaggaaaacgagcctaagaggactttcataccgacaacatctgaaaggactagaatgttcacaccacgatctggatttcttaattttttgtttttgtttttgttgttctctagttctacgggtttgattatttagtcatgtgaaaaatattgattactcacacatagatcaagagagacacggctcctgccttcatggagcttttaggggaaaatgaagtggctcttgcagctagagttgactcagaagccgaaattcctagaaatcaggtttctactgctaggcaattgaagtataaactattttataaacac

SEQ ID NO: 2051 - DNA, 1497 bp, Homo sapiens
acagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacg

SEQ ID NO: 2052 - DNA, 1511 bp, Homo sapiens
cattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccagtcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgac

SEQ ID NO: 2053 - DNA, 2513 bp, Homo sapiens
cacagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtgaatgaatgcacctccggacaaaacccatgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccaggcccttctgtggtgggccttgtctccattccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgtgaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaa

SEQ ID NO: 2054 - DNA, 6738 bp, Homo sapiens
ggggggtctgctctgtgcggtgaagcttctcttcttggcacctgcctggcatcggaagagggccccttctccctccctgggcttttatgtggacactgtaatgcctcagttttctttctttctttttgtttttgacacagggtctcactctatcacccaagctggagtgcagtggcaccatcttagctcaccgcagcctcaaactccccagctcgggtgattcttcctgcctcagcctcctgagtagtagcagctgggaccacagacgtctgccaccaagcccagctgcaccgccagttccggggagggccctgggccagcggctgtccgccccccctcctttataaagtcctggcctcgggacagcccgcacagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtgaatgaatgcacctccggacaaaacccatgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgttcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaaggatgttatggaaggcgtgctaggcattcaattcctgcagaaaccggaaatcttccatgccctgcaatgtgctcatcaaactctcagcatatggacggccagctgtggcccatatcttggtcactctgaagcacaatatttatgaagctatagaacgttaagacctctttcacagcctctccttcctacaaagactcctccaaatcttaaaatgaagcaggaaaacgagcctaagaggactttcataccgacaacatctgaaaggactagaatgttcacaccacgatctggatttcttaattttttgtttttgtttttgttgttctctagttctacgggtttgattatttagtcatgtgaaaaatattgattactcacacatagatcaagagagacacggctcctgccttcatggagcttttaggggaaaatgaagtggctcttgcagctagagttgactcagaagccgaaattcctagaaatcaggtttctactgctaggcaattgaagtataaactattttataaacactgtcttctttcgtcttcacaccaacatgcagaaaagtttctaatctcagatcggggatgtgcaacaaattccatttcaaaggaatgacctgcaaaactcctaaatattccaagcaaatgcccttaaccctgtctgttatctgctttccttgaacagaaattctacatgaccataaaacctcgaagatgggtatggcacagttcatgccctgtaatcctagcactttgggagggtgaggcaggaggatggctcaagcccaggagtttgagaccagtgtgggcaacagagtgagaaccatctctacccaaaaaaaaaattaaaaattagccaagcatggtgatgatataggagttaaggagaaatcatttaggcaaatagcaagggtaggaagtcctcagtaaggttttccatttaatgaaaagcagcccccaaaatcattttcttttctaacaaagaacagcctgtaaaatcgagctgcagacatagacaagcaagctggaagcttccacgggtgaatgccggcagctgtgccaataggaaaaagctacctagactaggcatgtccaaaatggcggctccaagttcccttctctttgccagccatgtgtacagtaaaaagcaggcaacatagtgtcagccaaagctcatttgcataataagattagggtggggtggccagctcacataggggtaggccctaggtaaatcagacaccgccttctcaagcctgtctataaaatctggtacactatgacgagggtcagatttcccattcagacgcccctctcccatgcaagagaaagagctgttctcctttctctttcttttgcctattaaacctctgctcctggccaggcacagtggctcacgcctataatcccagcactttgggaggctgaggtggtcagatcacctaaggtcaggagttcaagaccagcctggtcaacatggtgaaatcttgtctctagtaaaaatacaaaaatatatgaaatctcacatagatgataatattaagttccaaaagcaactcaacctggtagattctaattttttttgaggcagggtcttgctttgtcacccatgctggagtacaatggcacaaacactgctcactgcagcctcgacctcccaaggcctaagcaatcctcctgcctcagtccccctccaggtatttgaaactacaggtgtgtaccaccacaccgggctaatttttgtattttttgtagagacgtgggtctcactatgctgcccaggctcaggtcttaatctcctgagctcaggcaatccgcaggcctcagcctccctaagtgcggggattacaggcttgagccactgcacctagcctctatttgttttacaaaagagaaattgagatcctgaatgttaagtgacttgcctgaggccatcccactaacaggagccagggttaggattcaaaccccatccaactggtcccagagctggagcttcttgcactgccctacactacctaccatctccatcctctgggcacctttttataagaaccaaaacattacagagcattgctttgtcaactcagctgggaacatttcccagtgcaactcacatttttcactgctctgtgcctgtccgtataagctcaatgagtattgatttaggggctttggagaactttgaatgctaccccccaagtaaccattgttggcaacctggtacctctacttttagccatttctccttctctataaatagtgcagaagtaacccacttggtaacaggcatccttgccaagcctccaccactaggtcagtgtaagaattaaagaaagaggaaagaaacacaaaaagtggcttgatggttaagacaggtttattttagagaaaacacacctgagaggggctgctggctgaattaggttagagtcttttctacagactaagagtgtttaaggatttagggtgggagagtttcttagaggcttggactgcttctgtgttttttttgttgtgcttatatgggagggagagtggtgtgtttgcttttatacatttttctgcagctgtaggcataccccccaagtctgcttttagcttccctattttagtgcacctggagggaaaggaatgtgcttattaaggcccactgttttactggggcccattgtatgagggtgaagtttggcagttacccaagagacttttcctccaccttcctctgtgcccgagctgttttatctgcattttactgtctgctttttttggctgcttatagtttttaaaaaagtaatttccttaaatccagaaggctaaaaatgaagctgaaacttaaagtggcggtgtttgtccaaaataacggggctcctgctctgccagtcagtaccctcaagtcactcctgatcctcaacctccatgcctaaggctggttcaagagaccacataatatctgccttttattacatacatgatgggtgcatgggattctgcgtgccctttgcttgatatagactgctaaggtgagatggggaatatcagagtcagctgctgcttgaggaagcagaacacacagctggaggcttggaacatgtgggtccctatgagtgtagagcccatatccccatagagtctacctagagcaggggtcgccaaatgttttcttaaagagcctgatagtgtatatgttaggctttgtgagccaggtatttacagcaactcaattctaccactgtggtatgaaaacagctatagacaatcataaatgaatgatcatggctatgttttaataaaactttacagacactgaacttgaacttccattgtgatatgaaaacagctatagacaatcataaatgaatgatcatggctatgttttaataaaactttatggacactgagcttgaacttcatatatcagtcatgtgacacaaaatatcattcttctttttatttgttttcacccatttgaaaaatgtaaaaactattcttagctgtacagaaacagatggtgggtcagatttgactcactgcccatagtttccagaccatgatgttcaggttcatggaagcacttcactctacactaatttattcatccattcatcacatatgtgatgagcacatacagacacacctcagagatattgcaggctccactccagatcaccacaataatgtgaatattgcaataaagcaagtcatacacatt

SEQ ID NO: 2055 - DNA, 6138 bp, Homo sapiens
gctcgctcggtctccggctccggcgccggctcctgctcctcctggccgcccggggccaaggcgacgagaggttgtaaaaatccatgtgggacggccccggggcgagcatcggaaagatctctgagtggagttattttctggtacggactgtgaaaagaatgcggtgaaaattctggacaatcgtggaaatattagctcaaaccccaacttaatatagcatttcttctcttcagtaacacctcataatacaagaaaaatgtatggaagtgcaagaacaatcaccaatctggaaggtagcccttccagatcccctcgtttgccaaggtctcctcgtttgggccaccgaagaacaagtagtgggggaggtggaggaacaggcaagactctgtctatggagaatatccagtccctcaatgcagcctatgctacgtctggacccatgtatctgagtgatcatgaaggggtggcttcaacaacctacccaaagggcactatgactctgggaagggctacaaatcgagctgtatatggaggccgtgtcacagccatggggagtagtcccaatattgcttctgctggactttcccacacagatgtcctttcatacacagatcaacatggtgggctgactggctcatcccatcatcaccaccaccaggtcccctccatgttgaggcaggtaagagacagcacaatgttagatcttcaggcccagctgaaagaactgcagagagagaatgacctcctccggaaagagctagacatcaaggacagcaaattgggatcttccatgaacagtattaagactttctggagtcctgagcttaagaaggagagagtcttgaggaaagaagaggcagcgcggatgtctgtcctcaaggagcagatgagggtttcccatgaagaaaatcagcacctacagttgacaatccaggcccttcaagatgagctgcgaacccagagagacctcaaccacctcctccagcaagagagtggcaaccgaggagcggagcacttcaccatcgagctgaccgaggagaactttaggcggctccaagccgagcatgacaggcaggctaaggagctgttccttttgaggaagacattagaggaaatggagctgagaattgaaacgcagaaacaaaccctcaatgcccgagatgagtcaattaaaaaacttcttgagatgttgcaaagtaaaggcttgccatccaaaagcctggaggatgacaatgagcgaacgcggcggatggcagaggctgagtctcaggtcagccacttggaagtgattttagatcagaaagagaaggaaaacatacatcttagagaggaattgcaccgaagaagccaacttcagccggagccagccaagacgaaggctctccagactgtcatcgaaatgaaggacacaaaaatcgcttcattggaacgaaacataagggatcttgaggatgagatccagatgttaaaagccaatggtgtgctgaacactgaggaccgcgaagaagagatcaaacaaattgaggtttacaaaagtcactccaagtttatgaagaccaagattgatcagctgaagcaggaactttcaaagaaagagtcggaacttcttgccttacaaacaaagcttgaaaccctcagcaatcaaaattcagattgcaagcaacacattgaagtgctcaaagagtcacttactgccaaagaacagagggctgccatccttcagactgaggtagatgcgctgagattacgactggaagaaaaagaatctttcctcaataaaaaaacaaaacagctacaggacctcacagaagagaaggggacactggccggtgaaattcgtgacatgaaagatatgttagaagtgaaggaaagaaaaatcaatgttcttcagaaaaagattgaaaacttgcaagaacaacttagggataaagacaagcaactgaccaacctgaaagacagagtgaagtccttgcagacggattccagtaatacagatactgcactggcgacgctagaggaagctctgtcagagaaggagagaataattgagcgcttgaaagaacagcgagaaagagatgatcgggaaagactagaagagatagaatccttccgaaaagagaacaaagacctgaaagagaaggtcaatgctttacaggctgaactgactgagaaagagtctagtttaattgacctcaaagaacatgcatcttcattagcctctgcggggctgaaaagggattccaaattaaaatctctagaaatagccattgaacaaaagaaagaggaatgtagcaaattggaagcacagttaaaaaaggcacataatattgaagatgactccaggatgaaccctgagtttgcagaccaaataaaacagctcgataaagaggcgtcttactaccgcgacgagtgtggcaaggcccaagcggaagtggaccggttgctggagatcctcaaggaggtggagaatgagaagaatgacaaggacaagaagatcgcagaactggagagcttgactctcaggcatatgaaagatcagaataagaaggtggccaacctcaagcacaatcaacagttggaaaagaagaaaaatgctcagttactagaagaagtgcgcaggcgagaagacagcatggctgacaactcacagcatttgcagatagaggaactgatgaatgcactggagaagaccagacaggaactggatgccaccaaagcacgcctcgcctccacacaacagtccctggccgaaaaagaagcgcacttggccaacctccggattgagaggaggaaacagctggaggagatcctggagatgaaacaggaagcactacttgcagccatcagtgaaaaagatgcaaacattgccttgctggaattgtctgcctccaaaaagaaaaagacgcaggaagaagtcatggccctcaagcgggaaaaagaccgactagtacatcaattaaagcagcagacccagaacagaatgaagttgatggcagacaactatgatgatgaccatcaccattaccaccaccaccaccatcaccaccaccatcgatctcctgggaggtcgcaacattccaatcacaggccctctccggaccaggatgacgaggagggcatatgggcatagccgggcctgtaaaccaaagttccagttttgttttgagggctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttggcagtgtttgtataccatgatgcatggagtgtttgacgaagaaacaaaaaacaccaaaaattgcgagcctttaccctcctctatttctttaatctgttgtttgaagaaccgcattttgagggtgtaaccagtagtcacctctgggccaggttggaaaagaaatcaattttttaaaccactaatgcttgccaagaaatcgccttatgagaacatggtgtgtgtctctgacaatgcgtggcacatctaaattgatcattcataattttatctacccagtcatgtactggagagtggcaaaagtctgaggcacctgcatatctctagtccctgtgttctgcacatccccacggtggggacgccaccaagcctcagactcttaccatcccggtgcatgcaggtctccatgaagaagctgggactcattcacatttcaagatccaaatgctgtgcaaacagtgtaagcttagattttctgtaaatgaagggtcatttctctttttttttttttttaaagaaaatgtgtctgcaacatggattccaaagcattttcagcatcaaacatgaaaacattgatgaatgaggaacaatcacaaaagctgtgtctctgtatatagctctacacaacatgtatgtggatacagtcattatttaaagcacatgccagggaaaaagaccaaattttgaggtcttttacatacagtgatatggtactaaggagaattaaactcctactgcttcctctgaatattaagaaacaatttaaattgttataacttcataaaactcatgactgagtctggcaaacatgtgcaactcttgtattgctccattttcttgtcaatggaagaaacccttccacgtgtatgcaagtgggagatgaaaacctgcatttttaaaggacaaacagtgaatttaagcatgagtggccttaataaatatagttgtctttctttgctgctgtggaaaggattctaaacagatgtccctgaagtcttgcattgaatttagtcattattattactttttaaaatgttggtgcaattaactctggacctctcttgtgagccatagagatatttaaaagacaaacaccttatttgtcggggaagatgaaaccgtccctgagttgcaccattctttcttggtgcattcgcggttaagatactcaagcaggtttcttgcttctggctttgttcttgtcatcagtaagtataacaaactatgtaatgcttatgtgttgcataaacaatccaaatgcattcatgttttaaaagtttgtcctttaactatcagagggatctaggtcttggttagagaagtaagcagagttctttgcaagcttatttagcacattttgacacaatgttgcactgaaaacccaggccacaaatgtgtcccagtgaacagtttggatgtcctcaaagaagtggttctcactgcctcctacaaccaggtcttgacctgaactctgcaactgaatacttgaagtaggaagtaggaaatccagtagggaaaatagggtccttgaaacagaaaaaaaaaaccaacccatgtatagctagctatttctatgtatgtgccaattttgtcacagctcttgtttggagggatcattttctgcccaactttcattggttaaaatattactgatcttacctttatgaggtcgtataatttagtcccttaaaaattaaattctctctaacataacaacctttcccatttcgtgtaatattctctgatgtttgggggttaccaaaaatatccctttttcacatattaagaatagtctctgggtttacaacaaacactgtgatgttgggaagctatttcctttgcgcaaactttaacaggttttcttctaatcataacatagttgaaaaaagaagtttgggctaacatttaggagaagttggtcttactttgtgcaaaagcaggcttgtgctttataccccatttgatttcgatgtacagtctcaattttgtatttaatgatttttgtgtatccagtatgcacgttaacagcgtgtcaactttcatttgaaagtgggtttcaatttactttttaaacagtgtttatgacgagacctcagatgtgttgacgtaagctctatctgcaatgtttttgtgtagagtggcgattgaatgctgcccagggtcagtgtatctaattccccgagaccctcgtttgatagtgcttcttgtaatatttcttcaagtgagtggcatgtgggttgtgatattgaccatgtgattatggacatcgatatgaaaaataaataaataaaactaaggaaccctggaaactaccagtgggcatgtattagccagtcattgtaacctcgtgtctagtagaacaatgtacaaggtatgtacagttcataaatttgttgtcatgtgtatgagaagtactttgtgctgatcgccttatttatattcatcaaataaaccttgtttctttctgaagtg

SEQ ID NO: 2056 - DNA, 3831 bp, Homo sapiens
cggctcctgctcctcctggccgcccggggccaaggcgacgagaggttgtaaaaatccatgtgggacggccccggggcgagcatcggaaagatctctgagtggagttattttctggtacggactgtgaaaagaatgcggtgaaaattctggacaatcgtggaaatattagctcaaaccccaacttaatatagcatttcttctcttcagtaacacctcataatacaagaaaaatgtatggaagtgcaagaacaatcaccaatctggaaggtagcccttccagatcccctcgtttgccaaggtctcctcgtttgggccaccgaagaacaagtagtgggggaggtggaggaacaggcaagactctgtctatggagaatatccagtccctcaatgcagcctatgctacgtctggacccatgtatctgagtgatcatgaaggggtggcttcaacaacctacccaaagggcactatgactctgggaagggctacaaatcgagctgtatatggaggccgtgtcacagccatggggagtagtcccaatattgcttctgctggactttcccacacagatgtcctttcatacacagatcaacatggtgggctgactggctcatcccatcatcaccaccaccaggtcccctccatgttgaggcaggtaagagacagcacaatgttagatcttcaggcccagctgaaagaactgcagagagagaatgacctcctccggaaagagctagacatcaaggacagcaaattgggatcttccatgaacagtattaagactttctggagtcctgagcttaagaaggagagagtcttgaggaaagaagaggcagcgcggatgtctgtcctcaaggagcagatgagggtttcccatgaagaaaatcagcacctacagttgacaatccaggcccttcaagatgagctgcgaacccagagagacctcaaccacctcctccagcaagagagtggcaaccgaggagcggagcacttcaccatcgagctgaccgaggagaactttaggcggctccaagccgagcatgacaggcaggctaaggagctgttccttttgaggaagacattagaggaaatggagctgagaattgaaacgcagaaacaaaccctcaatgcccgagatgagtcaattaaaaaacttcttgagatgttgcaaagtaaaggcttgccatccaaaagcctggaggatgacaatgagcgaacgcggcggatggcagaggctgagtctcaggtcagccacttggaagtgattttagatcagaaagagaaggaaaacatacatcttagagaggaattgcaccgaagaagccaacttcagccggagccagccaagacgaaggctctccagactgtcatcgaaatgaaggacacaaaaatcgcttcattggaacgaaacataagggatcttgaggatgagatccagatgttaaaagccaatggtgtgctgaacactgaggaccgcgaagaagagatcaaacaaattgaggtttacaaaagtcactccaagtttatgaagaccaagattgatcagctgaagcaggaactttcaaagaaagagtcggaacttcttgccttacaaacaaagcttgaaaccctcagcaatcaaaattcagattgcaagcaacacattgaagtgctcaaagagtcacttactgccaaagaacagagggctgccatccttcagactgaggtagatgcgctgagattacgactggaagaaaaagaatctttcctcaataaaaaaacaaaacagctacaggacctcacagaagagaaggggacactggccggtgaaattcgtgacatgaaagatatgttagaagtgaaggaaagaaaaatcaatgttcttcagaaaaagattgaaaacttgcaagaacaacttagggataaagacaagcaactgaccaacctgaaagacagagtgaagtccttgcagacggattccagtaatacagatactgcactggcgacgctagaggaagctctgtcagagaaggagagaataattgagcgcttgaaagaacagcgagaaagagatgatcgggaaagactagaagagatagaatccttccgaaaagagaacaaagacctgaaagagaaggtcaatgctttacaggctgaactgactgagaaagagtctagtttaattgacctcaaagaacatgcatcttcattagcctctgcggggctgaaaagggattccaaattaaaatctctagaaatagccattgaacaaaagaaagaggaatgtagcaaattggaagcacagttaaaaaaggcacataatattgaagatgactccaggatgaaccctgagtttgcagaccaaataaaacagctcgataaagaggcgtcttactaccgcgacgagtgtggcaaggcccaagcggaagtggaccggttgctggagatcctcaaggaggtggagaatgagaagaatgacaaggacaagaagatcgcagaactggagagcttgactctcaggcatatgaaagatcagaataagaaggtggccaacctcaagcacaatcaacagttggaaaagaagaaaaatgctcagttactagaagaagtgcgcaggcgagaagacagcatggctgacaactcacagcatttgcagatagaggaactgatgaatgcactggagaagaccagacaggaactggatgccaccaaagcacgcctcgcctccacacaacagtccctggccgaaaaagaagcgcacttggccaacctccggattgagaggaggaaacagctggaggagatcctggagatgaaacaggaagcactacttgcagccatcagtgaaaaagatgcaaacattgccttgctggaattgtctgcctccaaaaagaaaaagacgcaggaagaagtcatggccctcaagcgggaaaaagaccgactagtacatcaattaaagcagcagacccagaacagaatgaagttgatggcagacaactatgatgatgaccatcaccattaccaccaccaccaccatcaccaccaccatcgatctcctgggaggtcgcaacattccaatcacaggccctctccggaccaggatgacgaggagggcatatgggcatagccgggcctgtaaaccaaagttccagttttgttttgagggatgatccagctctgtcggaggcacgtaggcacagccaaatctcatgctgtacattgatcacctgtccaacctttgcctagagtgggagcccccagttccttcgagatccaacattacctgtctgtaaagaagaagaggaggagggagacagcggggaggatccggtggcagtttaacaccagagcagctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttgg

SEQ ID NO: 2057 - DNA, 1585 bp, Homo sapiens
gaagaagccaacttcagccggagccagccaagacgaaggctctccagactgtcatcgaaatgaaggacacaaaaatcgcttcattggaacgaaacataagggatcttgaggatgagatccagatgttaaaagccaatggtgtgctgaacactgaggaccgcgaagaagagatcaaacaaattgaggtttacaaaagtcactccaagtttatgaagaccaagattgatcagctgaagcaggaactttcaaagaaagagtcggaacttcttgccttacaaacaaagcttgaaaccctcagcaatcaaaattcagattgcaagcaacacattgaagtgctcaaagagtcacttactgccaaagaacagagggctgccatccttcagactgaggtagatgcgctgagattacgactggaagaaaaagaatctttcctcaataaaaaaacaaaacagctacaggacctcacagaagagaaggggacactggccggtgaaattcgtgacatgaaagatatgttagaagtgaaggaaagaaaaatcaatgttcttcagaaaaagattgaaaacttgcaagaacaacttagggataaagacaagcaactgaccaacctgaaagacagagtgaagtccttgcagacggattccagtaatacagatactgcactggcgacgctagaggaagctctgtcagagaaggagagaataattgagcgcttgaaagaacagcgagaaagagatgatcgggaaagactagaagagatagaatccttccgaaaagagaacaaagacctgaaagagaaggtcaatgctttacaggctgaactgactgagaaagagtctagtttaattgacctcaaagaacatgcatcttcattagcctctgcggggctgaaaagggattccaaattaaaatctctagaaatagccattgaacaaaagaaagaggaatgtagcaaattggaagcacagttaaaaaagcaagctgagcagttgttcaatcagatgtacaacccagcacataatattgaagatgactccaggatgaaccctgagtttgcagaccaaataaaacagctcgataaagaggcgtcttactaccgcgacgagtgtggcaaggcccaagcggaagtggaccggttgctggagatcctcaaggaggtggagaatgagaagaatgacaaggacaagaagatcgcagaactggagaggcatatgaaagatcagaataagaaggtggccaacctcaagcacaatcaacagttggaaaagaagaaaaatgctcagttactagaagaagtgcgcaggcgagaagacagcatggctgacaactcacagcatttgcagatagaggaactgatgaatgcactggagaagaccagacaggaactggatgccaccaaagcacgcctcgcctccacacaacagtccctggccgaaaaagaagcgcacttggccaacctccggattgagaggaggaaacagctggaggagatcctggagatgaaacaggaagcactacttgcagccatcagtgaaaaagatgcaaacattgccttgctggaattgtctgcctccaaaaagaaaaa

SEQ ID NO: 2058 - DNA, 4281 bp, Homo sapiens
gcataactgatggagggccgggcgcggtaagagcgtctcgggggagtggggcaaggcggccgggcccctcccattccgccttttcttcagcgtcctacccgcggcactggctgcgagcgccgggccacctgcgagtgtgcgcagggactctggacacccgcggcggcgagctgagggagcagtctccacgaggacccaggcggaccctctggcgccatgcgcgccctccccggcctgctggaggccagggcgcgtacgccccggctgctcctcctccagtgccttctcgctgccgcgcgcccaagctcggcggacggcagtgccccagattcgccttttacaagtccacctctcagagaagaaataatggcaaataacttttccttggagagtcataacatatcactgactgaacattctagtatgccagtagaaaaaaatatcactttagaaaggccttctaatgtaaatctcacatgccagttcacaacatctggggatttgaatgcagtaaatgtgacttggaaaaaagatggtgaacaacttgagaataattatcttgtcagtgcaacaggaagcaccttgtatacccaatacaggttcaccatcattaatagcaaacaaatgggaagttattcttgtttctttcgagaggaaaaggaacaaaggggaacatttaatttcaaagtccctgaacttcatgggaaaaacaagccattgatctcttacgtaggggattctactgtcttgacatgtaaatgtcaaaattgttttcctttaaattggacctggtacagtagtaatgggagtgtaaaggttcctgttggtgttcaaatgaataaatatgtgatcaatggaacatatgctaacgaaacaaagctgaagataacacaacttttggaggaagatggggaatcttactggtgccgtgcactattccaattaggcgagagtgaagaacacattgagcttgtggtgctgagctatttggtgcccctcaaaccatttcttgtaatagtggctgaggtgattcttttagtggccaccattctgctttgtgaaaagtacacacaaaagaaaaagaagcactcagatgaggggaaagaatttgagcagattgaacagctgaaatcagatgatagcaatggtatagaaaataatgtccccaggcatagaaaaaatgagtctctgggccagtgaatacaaaacatcatgtcgagaatcattggaagatatacagagttcgtatttcagctttgtttatccttcctgttaagagcctctgagtttttagttttaaaaggatgaaaagcttatgcaacatgctcagcaggagcttcatcaacgatatatgtcagatctaaaggtatattttcattctgtaattatgttacataaaagcaatgtaaatcagaataaatatgttagaccagaataaaattaattatattctggtcttcaaaggacacacagaacagatatcagcagaatcacttaatacttcatagaacaaaaatcactcaaaacctgtttataaccaaagaattcatgaaaaagaaagcctttgccatttgtcttagaaagttattttttaaaaaaaaatcatacttactattagtatctatggaagtatatgtaacaatttttatgtaaaggtcatctttctgtgatagtgaaaaaatatgtctttactaagttgaaatgaatactttctgcctttgctaatgatagttattctacaatctccacaagaaaaatataccttttatccggaaatattggtttaaggcaaataaataaaactgtgcttgctctaaagctctgcactacaaaagcaaattttccagtctttattccactcataaccactgctttccccaccaggctaaagtgcttcttagtcttaaatagggtttttaacttcataaggtacaccattgtttatgttttagggtgcaggtccatatagtcgtaatacttaaaacactgctacactgatgcttttgtggctcatggtttcctggttctttgatttaacacctggcttcctggtatctatggctggttaaatatctaaacctgcattattagtgctttacaataataattcccttgactgaagtccagaaatactaaagcacttcttttttattgctgtgaatgccttagacttatcttccaaaataggatacttcgtttctattgcatatataactgaaatattttataaactcactgtaatcaaatcttataaaatctgaatcaacatgaaaagttgtcaatgcttgaatgaatactaaaatcataccacaagatactagataacataaatgaccatgaagtgtcccactgctcaaagggcaacaactttaagaacagaagcaaagagtggtggtgtggaacccaagattcttggcgactagggaatttaaaggttggggaggaggaattcaatgatttgacaagaaatactttataaaaatttgctccatgtattggctaagaaaaatataataaaattttggtagtgaaaattgtatcactaatgtttaccaatattactagtatgaataatacacataaggtagtgacttggaagctgctcaatactttgttgctataacaaaatgcaatattttgttgtaaagcatcttaactacacatataagtttgctgaacttgaatacatcccggtaatggcaaacttcattttattcttggttttcattttattctggtctcagggccatacatttattttagtttaattaattattattttgacaacattacttgggtaatatctatataatggtagataaccaatcagttagcttaattaatctaagctatttgaattcagggaaatattagtcaaatctgctgtttgactaaatacaattcaaagcagtgtatttgtgacttggaatatagaacacaaacaaatgtgtaacccatctgcagtatgcattcttccattttaccaccactaaccattgaggctcatacaattttcaagcaacaagcattgcttcccaaaggtaaaataatcaggaatatttctatagtaaatggagtttttaattggcaatactgtttatttttttctagcaaagacaatttatctcagtaaccttaaataggaaaagtactcaaaaattaaagttgacttttggctttttgtagtctctctggaggacttccagaaaattaccactgttggattttaatctgcttccattaaccaatcttacagagatgataaatgaattaactaatattgaccaaatataaattgactgcaaataataagccgcataaaagttgaagtaggaaaactactccaagtttatatattaggcaccttggggaattctcttagtctttccagctaacaaggattttcagcataataagtagatttaatgatggcataaaattcccagatactttcatatacattttttgccaaagtgtaaatcttctccttttgcagtctttttgttattatcccaacatctagctgctcaggccctaatttagaactcattctgatattttcttcttctgtattaattaatacttatgggtcatgaatccctgctcctttgacctttttaatagctcatgaatccatcccattgcctccccaactctgcccacacctgctgcaacactaatgccttgattttcctacctcagtctccttttctattaatccctcttttgcgtggctgcctgagtccactttctcaaacacaaacctcactatgcaactttggaatctctgtaggctcacctttgccatttcttaatattgcattctccaaattgctaatctctatccagtctcttgaactagacttggcacatggagattccgctcagaaagtgctcttcacacttctacctgcttgactaaccccagattatctttcaagactttaatctgatcttgtgtcttagagaagcccccatacctggtagagcatgtaccatcttacatgcttaaataactccacatttatttgtgtttattactctgtgttataaatatacatttgttggtctctctcttggattattttgtttctttgtcctgtaactaccactgaaagggtgcaatacagctttcttgaaatgtgtattgaacggatgaatgtataaataaaaattaaattttgtaaatttctgcttattcttagaaaaagaatctaaattgtgacaaatcagaattgaaaaaagtattctaataaagaaaaacaagcttttataacttca

SEQ ID NO: 2059 - DNA, 914 bp, Homo sapiens
tgctttcctctgccgcatggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggaaggcccttttgtctacttgtctttagtaggaaacgttgcaaattccgatggcttgattgcttctttatggaaagaatatggcaaagctgatgcaagatgggtttattttgatccaaccattgtgtctgtggaaattctgaccgtcgccctggatgggtctctggcattgttcctcatttatgccatagtcaaagaaaaatattaccggcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaattataca

SEQ ID NO: 2060 - DNA, 1042 bp, Homo sapiens
cgtttctctccctgctttcctctgccgcatggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggagagagtgggaaagaccacgaaccaggagagtgctggggtcctgggatccacagaatggaatttcaagaacactgataaattgctgtagcaccattaaaaaaaaagaaagaaaataaaaggaaggcccttttgtctacttgtctttagtaggaaacgttgcaaattccgatggcttgattgcttctttatggaaagaatatggcaaagctgatgcaagatgggtttattttgatccaaccattgtgtctgtggaaattctgaccgtcgccctggatgggtctctggcattgttcctcatttatgccatagtcaaagaaaaatattaccggcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaatt

SEQ ID NO: 2061 - DNA, 1978 bp, Homo sapiens
gtgttagcttcttgtttctctattttctacctaggtttcagtttttcacttgggtttgtttcccctttgtctctggttcagcttccttttcctgtttggttttaagtaggctataaaaatcaagttgctgtcttcagagggtctgtggtcctctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 2062 - DNA, 2353 bp, Homo sapiens
ggtggggccccgcgccttttgtgtcgggctttgaccgccgcgcgcgctcattcacctcagcggccgcgggcggaggggcgcacgcgcgcgcagtcccctcggagggcggtggggcgaacagcaacgcgcgtaccctagctcttggctgctgtgctgagactagcccgcgcgcccgcgcgcctctccctcgaggactcggagccgcccgcgcactcgccaggggccgccgccccgagtctcaggcggacgcgcacgcgttcccgccgcccggaccccagccggctcgccccccgcccccccatcccccggcggcggcccccaggcacgcgcccgcgcacacgccggcccgggcacgcgcccgccaagatggcaggggccggggcccagctgtcagtcgccgccgccgcggcccttccccgcagctagcggccccgacgcccacccggagaagatgagcccccgctgccccccgcagcccagtcagacgcggagccgccgcgcccggggccggctcccccgctagcgcccgcgtcccgcgccccgccgccgccgccgccgccgccgggtcgcccctggcccggcgcgcccgtccccggcagcgacaatgagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 2063 - DNA, 1533 bp, Homo sapiens
gtggtcctctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtggagctccatcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacgg

SEQ ID NO: 2064 - DNA, 3704 bp, Homo sapiens
agttcccagcctggagcctaagcatacactgcattaatcagacttgctggaatgatcacatggttttctagctgcctcccctgttagctgccgcttgtcagcagctggcggagctggaggctgcaggcccctgtctgcagaaagccttttacttcagaatattggggggtgtggaaaccccgcctcatttttctgcactttgcaccatctgactaactaaatggttgtcctccataccaaaaagactaccacacaatctaaggaaattgtctctgactaggtcatgtttgcatttgaagaattcagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagg

SEQ ID NO: 2065 - DNA, 1119 bp, Homo sapiens
ccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaata

SEQ ID NO: 2066 - DNA, 3198 bp, Homo sapiens
gaacagggcacttggatctctcaaatggtgcagtgactcggataccttccctagtgccattacagtactggagactgccagctagatccatcacacccaagtgaagctgtggaaaagcccttaaactccagagccagaaccagcaacctcagctccggaatacacttgcaaggcactggaagatctaaaattcctctttaaacaaaaagataagtaatgccccaccaacatcctttcacctcaaagtaaggtgatcccaatactagaaattttactggcaattgctctgattgttatcactattttaaccctaacttgtacaccaccaggagttccattggcagctcgttttgtgaccagtttctcttaggtcaccatgggcctgctcctgctggttctcattctcacgccttcactagcagcctaccgccatcctgatttcccgttattggaaaaagctcagcaactgctccaaagtacaggatccccttactccaccaattgctggttatgtactagctcttccactgaaacaccagggacagcttatccagcctcgcccagagaatggacaagcatagaggcggaattacatatttcctatcgatgggaccctaatctgaaaggactgatgaggcctgcaaatagtcttctttcaacagtaaagcaagatttccctgatatccgccagaaacctcccattttcggacccatctttactaatatcaacctaatgggaatagcccctatttgtgttatggccaaaaggaaaaatggaacaaatgtaggcactcttccaagtacagtctgtaatgttactttcactgtagattctaaccaacagacttaccaaacatacacccacaaccaattccgccatcaaccaagattccccaaacctccaaatattacttttcctcagggaactttgctagataaatccagccggttttgccagggacgcccaagctcatgcagtactcgaaacttctggttccggcctgctgattataaccaatgtctgcaaatttccaacctcagctctacagcggaatgggttctattggaccaaactcgaaattctcttttttgggaaaataaaaccaagggagctaaccagagccaaacaccctgcgtccaagtcttagcaggcatgactatagccaccagctacctgggcatatcagcagtctcagaattttttggaacctccctcacccccttatttcatttccatatctctacatgccttaaaactcaaggagccttttatatttgtggccagtcgattcaccaatgcctccccagtaactggactggaacttgtaccataggctatgtaaccccagacatcttcatagcccctggcaatctctctcttccaataccaatctatgggaattccccgttgcccagggtgaggagggcaatccatttcattccccttctcgcgggactcggcattctagctggtacgggaaccggaattgctggaatcacaaaagcttccctcacctatagccagctctcaaaggaaatagccaacaacattgacaccatggctaaagccttaacgaccatgcaagaacaaatcgactctttagcagccgtagtccttcaaaatcgtcgaggactagacatgttaacggcagcacagggaggaatttgtttggccttagatgaaaaatgttgcttttgggtaaatcaatcaggaaaagtacaagacaacatcagacaactcctaaatcaagcctccagtttacgggaacgagccactcagggttggttaaattgggaaggaacttggaaatggttctcttgggttcttccccttacaggcccacttgttagtctcctacttttgctcctttttggtccatgtctcctaaatctaataacccaatttgtctcctctcgccttcaggccataaagctccagacgaatctcagtgcaggacgccatcctcgcaatattcaagagtcacccttctaaggaggacccctagactgctcgctagtggaacacgacagaggcgaaatcctgccccgtctcccgtggacctggctggatatggtttttgccaatccacagagccatcctgccctgacagctagcaagaggccaagacccacagaacaaccactacagcccctctgtcagcaggaagcagttaaagaagactgaccttcgtccattttcccagataattgggtcttggactcttgagggggggaaatgttggagcaggtagctagtcagacatgagcagggcaggggagggccccctcaccaggaatgtcaggcaaccatcaggtgatggtgaggcagttgttaagctgtgtctctaacataataatgagtggcagctggcgccagggaacgatggcctcccaatagataggaaacacctgaagctggtgatcagccacttcctgataagatctcaggagttgggtgcgcaggctcaagcatgcaccctaagaggcaaaatagtggcatttaactcatatatgaccttcctttaggaaggcttgactggtaagggaaaaactcctccagtgaacacgtgcacaacttcagtaaaaacactgcacatgcgtcccctcccaagtgctggcaggccactgtgcatgcagacagcccgccccaaagaaaaatcagaggaggagaaatggaaaccccggaacaatgccaatgtataaaaccccaagtcaagggcctaccaaggcaattggatctctcaagtcacccgcttggctctcttcaagtgcactttgcttccttttgttcttgctctaaaacttttactcctgctataaaacttgccttggactatcatgctaccttacgcctccccggccaaattccctcctctcctccggggggcaaggatggagtctgctgcagacccattggatttgctgctggtaacagttccaccatttaggttccagcaccaagcaaactaacacccgactcagtgtaaacagccaaacaagcttaaccaattagaaaccaccatctaacctctaactaggtcctttcaactttaaccaagtattttctttgtcttgcttctgtgggaaccttataaaattttcccccttgtacctctgtagtagagacccagttgcttgcagtttggccctgcctgttcatgaatcacccttgctcaaataaactctctaaaatgctaa

SEQ ID NO: 2067 - DNA, 3184 bp, Homo sapiens
tatttgaaagggccccttcaccattctattatctacccctacagccattacagtactggagactgccagctagatccatcacacccaagtgaagctgtggaaaagcccttaaactccagagccagaaccagcaacctcagctccggaatacacttgcaaggcactggaagatctaaaattcctctttaaacaaaaagataagtaatgccccaccaacatcctttcacctcaaagtaaggtgatcccaatactagaaattttactggcaattgctctgattgttatcactattttaaccctaacttgtacaccaccaggagttccattggcagctcgttttgtgaccagtttctcttaggtcaccatgggcctgctcctgctggttctcattctcacgccttcactagcagcctaccgccatcctgatttcccgttattggaaaaagctcagcaactgctccaaagtacaggatccccttactccaccaattgctggttatgtactagctcttccactgaaacaccagggacagcttatccagcctcgcccagagaatggacaagcatagaggcggaattacatatttcctatcgatgggaccctaatctgaaaggactgatgaggcctgcaaatagtcttctttcaacagtaaagcaagatttccctgatatccgccagaaacctcccattttcggacccatctttactaatatcaacctaatgggaatagcccctatttgtgttatggccaaaaggaaaaatggaacaaatgtaggcactcttccaagtacagtctgtaatgttactttcactgtagattctaaccaacagacttaccaaacatacacccacaaccaattccgccatcaaccaagattccccaaacctccaaatattacttttcctcagggaactttgctagataaatccagccggttttgccagggacgcccaagctcatgcagtactcgaaacttctggttccggcctgctgattataaccaatgtctgcaaatttccaacctcagctctacagcggaatgggttctattggaccaaactcgaaattctcttttttgggaaaataaaaccaagggagctaaccagagccaaacaccctgcgtccaagtcttagcaggcatgactatagccaccagctacctgggcatatcagcagtctcagaattttttggaacctccctcacccccttatttcatttccatatctctacatgccttaaaactcaaggagccttttatatttgtggccagtcgattcaccaatgcctccccagtaactggactggaacttgtaccataggctatgtaaccccagacatcttcatagcccctggcaatctctctcttccaataccaatctatgggaattccccgttgcccagggtgaggagggcaatccatttcattccccttctcgcgggactcggcattctagctggtacgggaaccggaattgctggaatcacaaaagcttccctcacctatagccagctctcaaaggaaatagccaacaacattgacaccatggctaaagccttaacgaccatgcaagaacaaatcgactctttagcagccgtagtccttcaaaatcgtcgaggactagacatgttaacggcagcacagggaggaatttgtttggccttagatgaaaaatgttgcttttgggtaaatcaatcaggaaaagtacaagacaacatcagacaactcctaaatcaagcctccagtttacgggaacgagccactcagggttggttaaattgggaaggaacttggaaatggttctcttgggttcttccccttacaggcccacttgttagtctcctacttttgctcctttttggtccatgtctcctaaatctaataacccaatttgtctcctctcgccttcaggccataaagctccagacgaatctcagtgcaggacgccatcctcgcaatattcaagagtcacccttctaaggaggacccctagactgctcgctagtggaacacgacagaggcgaaatcctgccccgtctcccgtggacctggctggatatggtttttgccaatccacagagccatcctgccctgacagctagcaagaggccaagacccacagaacaaccactacagcccctctgtcagcaggaagcagttaaagaagactgaccttcgtccattttcccagataattgggtcttggactcttgagggggggaaatgttggagcaggtagctagtcagacatgagcagggcaggggagggccccctcaccaggaatgtcaggcaaccatcaggtgatggtgaggcagttgttaagctgtgtctctaacataataatgagtggcagctggcgccagggaacgatggcctcccaatagataggaaacacctgaagctggtgatcagccacttcctgataagatctcaggagttgggtgcgcaggctcaagcatgcaccctaagaggcaaaatagtggcatttaactcatatatgaccttcctttaggaaggcttgactggtaagggaaaaactcctccagtgaacacgtgcacaacttcagtaaaaacactgcacatgcgtcccctcccaagtgctggcaggccactgtgcatgcagacagcccgccccaaagaaaaatcagaggaggagaaatggaaaccccggaacaatgccaatgtataaaaccccaagtcaagggcctaccaaggcaattggatctctcaagtcacccgcttggctctcttcaagtgcactttgcttccttttgttcttgctctaaaacttttactcctgctataaaacttgccttggactatcatgctaccttacgcctccccggccaaattccctcctctcctccggggggcaaggatggagtctgctgcagacccattggatttgctgctggtaacagttccaccatttaggttccagcaccaagcaaactaacacccgactcagtgtaaacagccaaacaagcttaaccaattagaaaccaccatctaacctctaactaggtcctttcaactttaaccaagtattttctttgtcttgcttctgtgggaaccttataaaattttcccccttgtacctctgtagtagagacccagttgcttgcagtttggccctgcctgttcatgaatcacccttgctcaaataaactctctaaaatgct

SEQ ID NO: 2068 - DNA, 3044 bp, Homo sapiens
ctttcacttaggcatcgatagcacccatcagatggccaaatcattatttactggaccaggccttttcaaaactatcaagcagatagtcagggcctgtgaagtgtgccagagaaataatcccctgccttatcgccaagctccttcaggagaacaaagaacaggccattaccctggagaagactggcaactgattttacccacaagcccaaacctcagggatttcagtatctactagtctgggtagatactttcacgggttgggcagaggccttcccctgtaggacagaaaaggcccaagaggtaataaaggcactagttcatgaaataattcccagattcggacttccccgaggcttacagagtgacaatagccctgctttccaggccacagtaacccagggagtatcccaggcgttaggtatacgatatcacttacactgcgcctgaaggccacagtcctcagggaaggtcgagaaaatgaatgaaacactcaaaggacatctaaaaaagcaaacccaggaaacccacctcacatggcctgctctgttgcctatagccttaaaaagaatctgcaactttccccaaaaagcaggacttagcccatacgaaatgctgtatggaaggcccttcataaccaatgaccttgtgcttgacccaagacagccaacttagttgcagacatcacctccttagccaaatatcaacaagttcttaaaacattacaaggaacctatccctgagaagagggaaaagaactattccacccttgtgacatggtattagtcaagtcccttccctctaattccccatccctagatacatcctgggaaggaccctacccagtcattttatctaccccaactgcggttaaagtggctggagtggagtcttggatacatcacacttgagtcaaatcctggatactgccaaaggaacctgaaaatccaggagacaacgctagctattcctgtgaacctctagaggatttgcgcctgctcttcaaacaacaaccaggaggaaagtaactaaaatcataaatccccatggccctcccttatcatatttttctctttactgttcttttaccctctttcactctcactgcaccccctccatgccgctgtatgaccagtagctccccttaccaagagtttctatggagaatgcagcgtcccggaaatattgatgccccatcgtataggagtctttctaagggaacccccaccttcactgcccacacccatatgccccgcaactgctatcactctgccactctttgcatgcatgcaaatactcattattggacaggaaaaatgattaatcctagttgtcctggaggacttggagtcactgtctgttggacttacttcacccaaactggtatgtctgatgggggtggagttcaagatcaggcaagagaaaaacatgtaaaagaagtaatctcccaactcacccgggtacatggcacctctagcccctacaaaggactagatctctcaaaactacatgaaaccctccgtacccatactcgcctggtaagcctatttaataccaccctcactgggctccatgaggtctcggcccaaaaccctactaactgttggatatgcctccccctgaacttcaggccatatgtttcaatccctgtacctgaacaatggaacaacttcagcacagaaataaacaccacttccgttttagtaggacctcttgtttccaatctggaaataacccatacctcaaacctcacctgtgtaaaatttagcaatactacatacacaaccaactcccaatgcatcaggtgggtaactcctcccacacaaatagtctgcctaccctcaggaatattttttgtctgtggtacctcagcctatcgttgtttgaatggctcttcagaatctatgtgcttcctctcattcttagtgccccctatgaccatctacactgaacaagatttatacagttatgtcatatctaagccccgcaacaaaagagtacccattcttccttttgttataggagcaggagtgctaggtgcactaggtactggcattggcggtatcacaacctctactcagttctactacaaactatctcaagaactaaatggggacatggaacgggtcgccgactccctggtcaccttgcaagatcaacttaactccctagcagcagtagtccttcaaaatcgaagagctttagacttgctaaccgctgaaagagggggaacctgtttatttttaggggaagaatgctgttattatgttaatcaatccggaatcgtcactgagaaagttaaagaaattcgagatcgaatacaacgtagagcagaggagcttcgaaacactggaccctggggcctcctcagccaatggatgccctggattctccccttcttaggacctctagcagctataatattgctactcctctttggaccctgtatctttaacctccttgttaactttgtctcttccagaatcgaagctgtaaaactacaaatggagcccaagatgcagtccaagactaagatctaccgcagacccctggaccggcctgctagcccacgatctgatgttaatgacatcaaaggcacccctcctgaggaaatctcagctgcacaacctctactacgccccaattcagcaggaagcagttagagcggtcgtcggccaacctccccaacagcacttaggttttcctgttgagatgggggactgagagacaggactagctggatttcctaggctgactaagaatccctaagcctagctgggaaggtgaccacatccacctttaaacacggggcttgcaacttagctcacacctgaccaatcagagagctcactaaaatgctaattaggcaaagacaggaggtaaagaaatagccaatcatctattgcctgagagcacagcaggagggacaatgatcgggatataaacccaagtcttcgagccggcaacggcaaccccctttgggtcccctccctttgtatgggagctctgttttcatgctatttcactctattaaatcttgcaactgc

SEQ ID NO: 2069 - DNA, 4765 bp, Homo sapiens
ccctcccccacgtgccctcgggagtcccggggaggagttgccgcgcggaggaggcgtggccgcggtgcctgcggaggcgcgagcggcgcggcgcggcgcggccgggactttggctttgacaccgactgcgagcgggagccgtgcggctggtgctgggtctggactggctctggcggatccccgcccgagttgggcgcaggactttttgccggggtaaacgcaactgcggcggcgccgccgcaagccccggtgcagcctcggcggcgggtttcgccgccgctgccgccgcctccgagcagccctgcggcttctattcactctgggagagcgatgctaagtttctcccatagaaagagccgggacacgcagaccgaagcggcgtagtcggcttccagggcctgaccagtgacccacacccgcgcggacgcctaggctggaggcagggggcccgtgctgtcccgggctgggctcaggcttccgagccgcaggtggaagaggaaccggcgccccgcagagcggccgagaggcggccaagtgaaaggtaattttggacacgccaggcatggaagattcggtgtttgtctatagtaacctcttcagtccctgaatcctgcaccttccgtttttctgtgcttgtacggcctactgggcttcctccctagccagagagctcttctgcagtggtgcggccttcccgggagcctgatcctggcggaccatggggagcaccctgggctgccaccgctccatccccagggacccctcggacctgtcccatagccgcaagttcagcgcagcctgtaacttcagcaacattctagtgaatcaggagcggctcaacatcaacactgccacggaggaggagctgatgaccctgcctggggtgacgcgtgccgtggcacgcagcatcgtggagtaccgagagtatatcggtggcttcaagaaggtggaggacctggcattggtcagtggtgtaggcgccaccaagctggagcaggtcaagtttgagatctgtgtgagcagcaagggcagctcagcgcagcactctcccagttccctgcggcgggacctgctagcggagcagcagcctcaccacctggccacagctgtgcccctcaccccacgtgttaacatcaacacagccaccccggcccagctcatgagcgtgcgaggcctctcggagaaaatggccctcagcatcgtggacttccgccgtgagcatgggccctttcgcagcgttgaggacctagtgaggatggatggtatcaatgccgccttcctggacaggatccggcaccaggtgtttgctgagaggtccaggcccccatccacccacacgaacgggggactgaccttcaccgccaagcctcacccgagccccacttccctgagcctgcagagtgaggacctggacctgccgccaggggggcccacccagattatctccactcggccgtccgtggaggcctttggaggcacaagggatgggaggcctgtgctgaggctggccacctggaacttgcagggctgttccgtggagaaggccaacaaccccggggtgcgagaggtggtgtgcatgacactcctggaaaacagcatcaagcttctagctgtgcaagaactgcttgacagagaggccttggaaaagttctgcacggagctaaaccagccgaccctgcccaacatccgcaagtggaaggggccccggggatgctggaaggctgttgttgctgagaagccctcgagtcagctccagaagggagctgggtatgcaggattcctatgggacgcggctgccggcatggagctgagagacgcgggttcacaggagagctcgccaagcaacgggcacgggaagctggcgggccccagcccatacctcgggaggttcaaggtgggaagtcacgacctgacccttgttaaccttcacctggcagccctgaccctcctggggagcgagaatcccagcaagaatcacagtgatggccaccggttggcgagctttgcacagaccctacaggaaaccctgaaaggagaaaaggatgtcattatcttaggggattttggccaagggccagacagcaatgactatgatatcctgaggaaagaaaagttccaccacctgatccccgcgcacaccttcaccaacatcagcaccaagaaccctcaaggctcgaagtctctggacaacatctggatcagtaaaagcttaaagaaggttttcacaggtcactgggctgtggtgagagaaggcctcacgaacccttggattccggataactggtcttggggcggggtggcttctgaacactgcccagtgctagccgagttctacactgaaaaggactggagcaagaaggatgcccctcggaacggcagcggggtggccttggagcgaagtgaagccaacatcaagcacgagcgatgatgacaccaaatccatgtgtccaccctgggacccaggagggcacagccaaggaatgagccctgtggggtgacgcttcagggcagagctgccttttaatttttattctcagagcatcagcacttgaggccttgccccacgccttctctgtggaccattcaggacctccagtgggggtggcgtgccaggcgcgtaccccaccaggtgggcaaagcagaaacctgcggggagcggagacgccttttatctctggatgccacagacctgagcagcattgggctggctgtccgctgctgactggatggcagcacaaagacaatatgagcagagggaggagaagaaggggtgctcaggctgcgggccacagtccagcagcgccagaagcactcatttctgaccaccaggctatgacgttcctgctgcgcattacagaaagcttttaactgtgatcaggcactctgctcagatacattgagtggcgatttttagttttgttttgaaaaaataaacagattaacctgcctcgctgcagtgagagcatgggacaagtccgccacagccctcccccgcccccttcccccgccccccaacgcgcagtgtgtatttgcaccacggcaggtgcctctgtgtggagctagggtcaagccctgagcagcttcacttcccctgcgccttttatgtccccaccttgaggccttgcagaggcgcctctcaaggccccatcagctcgccgggacctctgtgaagcctctctgtcatctccccttcccagcccctccttcatcccctgcctccttcaccagcctggcttttgcctggagcactatttgtttagttctctttgcaggacaagaattctctcagggtggtatcacctcctccctcctccccactcactccagtttttagcccggagcctcctgtggttgactatcaggaatgtgtgctgtgtcaggatacataggaagttgacctcggggtatcatggagagtgtccctcctagtggctggaggtagggacagttggttgtggggctggagagaggttgtggggaggaagcgaggatgcgtgcctgccactaggcatctgcatccccgagcccaagccaggagggatttcccttaggcaacaccatcccagggagatctgccacaatttgcgtttcacagctgaagacgctgaggcttagagagctcgacctcctcaaggtcacaccactgggtaaatagagggatgcagactcaggttttgctatgtgctcacatttcaactttatgcttaacatgaatggaaaaatatgaaagtaaatagtgaaaaggtaagttatgagcttagattacctagattattccagtatcccatggaagctgaggacttattccgctttccacaccgaacactaaatgtggaccagtatcaagaaccctcctgtccccacgcagtgtaaacccagtggcttctctgacctggagctgatgggccgtgaagggggcctatttttctccaaaggccatccttttggggccacctggctccaagaagcatcgctggtcttggggacgggaagggaaccctcttccaggagctctaagggtacttgggaatcaattgtgtccattctgaggtctctccagtgggagggcggcagctcctgtccctgggttcaggctgtgcttctggaagcatcgaaatgggatgtctgagccttgaggaaaagcagcagggttagcattaaagtcaagaggggcagctcaggatgctaccagggagcacatcgtttctggtgcctcatctaaaggtgaaacctcccctacattcaccagccggatgtcccaaatccctttagccagattgctttttgcaaccaaagctgtggacagaaaagcctccttaagtgagctgaggggacaggaaatccaatcagatgacctttgtgttcgtaatcgggcttgagccagaggctggggagctgagtcccagccaaacctcactggcccttttgcttttcacgcccagggctcagtggcccaggaagtgtgctgggcagcctgttcttactccagctcaacccattgggtgttggctgtttttggttttagttgttgttttgtattttgttgttttaattaataggctttatttgtaagagcagttttatgtttacagaaaaattaggcacaaagggattcccatatccctcctcttctttgcatatttccccctctaattagcatgttgcattagcatggcactttgttacaactgatgaacttgtattcattattagctacagtgttcatagtttatattaaagttcactctttgtgttgtgcatccta

SEQ ID NO: 2070 - DNA, 2769 bp, Homo sapiens
caccgactgcgagcgggagccgtgcggctggtgctgggtctggactggctctggcggatccccgcccgagttgggcgcaggactttttgccggggtaaacgcaactgcggcggcgccgccgcaagccccggtgcagcctcggcggcgggtttcgccgccgctgccgccgcctccgagcagccctgcggcttctattcactctgggagagcgatgctaagtttctcccatagaaagagccgggacacgcagaccgaagcggcgtagtcggcttccagggcctgaccagtgacccacacccgcgcggacgcctaggctggaggcagggggcccgtgctgtcccgggctgggctcaggcttccgagccgcaggtggaagaggaaccggcgccccgcagagcggccgagaggcggccaagtgaaaggtaattttggacacaccttccgtttttctgtgcttgtacggcctactgggcttcctccctagccagagagctcttctgcagtggtgcggccttcccgggagcctgatcctggcggaccatggggagcaccctgggctgccaccgctccatccccagggacccctcggacctgtcccatagccgcaagttcagcgcagcctgtaacttcagcaacattctagtgaatcaggagcggctcaacatcaacactgccacggaggaggagctgatgaccctgcctggggtgacgcgtgccgtggcacgcagcatcgtggagtaccgagagtatatcggtggcttcaagaaggtggaggacctggcattggtcagtggtgtaggcgccaccaagctggagcaggtcaagtttgagatctgtgtgagcagcaagggcagctcagcgcagcactctcccagttccctgcggcgggacctgctagcggagcagcagcctcaccacctggccacagctgtgcccctcaccccacgtgttaacatcaacacagccaccccggcccagctcatgagcgtgcgaggcctctcggagaaaatggccctcagcatcgtggacttccgccgtgagcatgggccctttcgcagcgttgaggacctagtgaggatggatggtatcaatgccgccttcctggacaggatccggcaccaggtgtttgctgagaggtccaggcccccatccacccacacgaacgggggactgaccttcaccgccaagcctcacccgagccccacttccctgagcctgcagagtgaggacctggacctgccgccaggggggcccacccagattatctccactcggccgtccgtggaggcctttggaggcacaagggatgggaggcctgtgctgaggctggccacctggaacttgcagggctgttccgtggagaaggccaacaaccccggggtgcgagaggtggtgtgcatgacactcctggaaaacagcatcaagcttctagctgtgcaagaactgcttgacagagaggccttggaaaagttctgcacggagctaaaccagccgaccctgcccaacatccgcaagtggaaggggccccggggatgctggaaggctgttgttgctgagaagccctcgagtcagctccagaagggagctgggtatgcaggattcctatgggacgcggctgccggcatggagctgagagacgcgggttcacaggagagctcgccaagcaacgggcacgggaagctggcgggccccagcccatacctcgggaggttcaaggtgggaagtcacgacctgacccttgttaaccttcacctggcagccctgaccctcctggggagcgagaatcccagcaagaatcacagtgatggccaccggttggcgagctttgcacagaccctacaggaaaccctgaaaggagaaaaggatgtcattatcttaggggattttggccaagggccagacagcaatgactatgatatcctgaggaaagaaaagttccaccacctgatccccgcgcacaccttcaccaacatcagcaccaagaaccctcaaggctcgaagtctctggacaacatctggatcagtaaaagcttaaagaaggttttcacaggtcactgggctgtggtgagagaaggcctcacgaacccttggattccggataactggtcttggggcggggtggcttctgaacactgcccagtgctagccgagttctacactgaaaaggactggagcaagaaggatgcccctcggaacggcagcggggtggccttggagcgaagtgaagccaacatcaagcacgagcgatgatgacaccaaatccatgtgtccaccctgggacccaggagggcacagccaaggaatgagccctgtggggtgacgcttcagggcagagctgccttttaatttttattctcagagcatcagcacttgaggccttgccccacgccttctctgtggaccattcaggacctccagtgggggtggcgtgccaggcgcgtaccccaccaggtgggcaaagcagaaacctgcggggagcggagacgccttttatctctggatgccacagacctgagcagcattgggctggctgtccgctgctgactggatggcagcacaaagacaatatgagcagagggaggagaagaaggggtgctcaggctgcgggccacagtccagcagcgccagaagcactcatttctgaccaccaggctatgacgttcctgctgcgcattacagaaagcttttaactgtgatcaggcactctgctcagatacattgagtggcgatttttagttttgttttgaaaaaataaacagattaacctgc

SEQ ID NO: 2071 - DNA, 2096 bp, Homo sapiens
gattacaggtatgagccaccacgcccggcctgtgctttagttctttacatgaaactccctttctaccttgtgttgcctggcaaaatcttacttacccagaactctgctccggcatcctccgcaggaagaacactttcattgaaccctagcattgtccctaatacccttaatatgtattgtcatagcaccctatgaatttttctatatcactttccatcttatatttaaataatctttttacttgcccatctctcccactgataatctaagctggcagaggctggatcagatcataattatctttctattcttagcgctaggatcaatgcctggcatagcatatttacattttttatttaaataaactgacctgactttcttctggttggatatgttctgagtccctattactaaccttggtcttttatctcagaagttgaaggctcccctggagccagctgcaaagttcccaaagccctaacaaccccacagccaatcagctacagagtaggctgccctgagtcggcctccccaacacaaagtccagggttggagcaggagcaggagagggacaatggaagctgccccgtccaggttcatgttcctcttatttctcctcacgtgtgagctggctgcagaagttgctgcagaagttgagaaatcctcagatggtcctggtgctgcccaggaacccacgtggctcacagatgtcccagctgccatggaattcattgctgccactgaggtggctgtcataggcttcttccaggatttagaaataccagcagtgcccatactccatagcatggtgcaaaaattcccaggcgtgtcatttgggatcagcactgattctgaggttctgacacactacaacatcactgggaacaccatctgcctctttcgcctggtagacaatgaacaactgaatttagaggacgaagacattgaaagcattgatgccaccaaattgagccgtttcattgagatcaacagcctccacatggtgacagagtacaaccctgtgactgtgattgggttattcaacagcgtaattcagattcatctcctcctgataatgaacaaggcctccccagagtatgaagagaacatgcacagataccagaaggcagccaagctcttccaggggaagattctctttattctggtggacagtggtatgaaagaaaatgggaaggtgatatcatttttcaaactaaaggagtctcaactgccagctttggcaatttaccagactctagatgacgagtgggatacactgcccacagcagaagtttccgtagagcatgtgcaaaacttttgtgatggattcctaagtggaaaattgttgaaagaaaatcgtgaatcagaaggaaagactccaaaggtggaactctgacttctccttggaactacatatggccaagtatctactttatgcaaagtaaaaaggcacaactcaaatctcagagacactaaacaacaggatcactaggcctgccaaccacacacacacgcacgtgcacacacgcacgcacgcgtgcacacacacacgcacacacacacacacacacagagcttcatttcctgtcttaaaatctcgttttctcttcttccttcttttaaatttcatatcctcactccctatccaatttccttcttatcgtgcattcatactctgtaagcccatctgtaacacacctagatcaaggctttaagagactcactgtgatgcctctatgaaagagaggcattcctagagaaagattgttccaatttgtcatttaatatcaagtttgtatactgcacatgacttacacacaacatagttcctgctcttttaaggttacctaagggttgaaactctaccttctttcataagcacatgtccgtctctgactcaggatcaaaaaccaaaggatggttttaaacacctttgtgaaattgtctttttgccagaagttaaaggctgtctccaagtccctgaactcagcagaaatagaccatgtgaaaactccatgcttggttagcatctccaactccctatgtaaatcaacaacctgcataataaataaaaggcaatcatgttataggagaaa

SEQ ID NO: 2072 - DNA, 4005 bp, Homo sapiens
tgcctagtcagttctgcgtccgctgaggctcggtcaccgcctcgctgtcgtcgcggcgcccccgccccgtcctctgtccgtaccgcccccggagccagggccgagtcctcgccatgccggcccggcggctgctgctgctgctgacgctgctgctgcccggcctcgggatttttggaagtaccagcacagtgacgcttcctgaaaccttgttgtttgtgtcaacgctggatggaagtttgcatgctgtcagcaagaggacaggctcaatcaaatggactttaaaagaagatccagtcctgcaggtcccaacacatgtggaagagcctgcctttctcccagatcctaatgatggcagcctgtatacgcttggaagcaagaataatgaaggcctgacgaaacttccttttaccatcccagaattggtgcaggcatccccatgccgaagttcagatggaatcctctacatgggtaaaaagcaggacatctggtatgttattgacctcctgaccggagagaagcagcagactttgtcatcggcctttgcagatagtctctgcccatcaacctctcttctgtatcttgggcgaacagaatacaccatcaccatgtacgacaccaaaacccgagagctccggtggaatgccacctactttgactatgcggcctcactgcctgaggacgacgtggactacaagatgtcccactttgtgtccaatggtgatgggctggtggtgactgtggacagtgaatctggggacgtcctgtggatccaaaactacgcctcccctgtggtggccttttatgtctggcagcgggagggtctgaggaaggtgatgcacatcaatgtcgctgtggagaccctgcgctatctgaccttcatgtctggggaggtggggcgcatcacaaagtggaagtacccgttccccaaggagacagaggccaagagcaagctgacgcccactctgtatgttgggaaatactctaccagcctctatgcctctccctcaatggtacacgagggggttgctgtcgtgccccgcggcagcacacttcctttgctggaagggccccagactgatggcgtcaccattggggacaagggggagtgtgtgatcacgcccagcacggacgtcaagtttgatcccggactcaaaagcaagaacaagctcaactacttgaggaattactggcttctgataggacaccatgaaaccccactgtctgcgtctaccaagatgctggagagatttcccaacaatctacccaaacatcgggaaaatgtgattcctgctgattcagagaaaaagagctttgaggaagttatcaacctggttgaccagacttcagaaaacgcacctaccaccgtgtctcgggatgtggaggagaagcccgcccatgcccctgcccggcccgaggcccccgtggactccatgcttaaggacatggctaccatcatcctgagcaccttcctgctgattggctgggtggccttcatcatcacctatcccctgagcatgcatcagcagcagcagctccagcaccagcagttccagaaggaactggagaagatccagctcctgcagcagcagcagcagcagctgcccttccacccacctggagacacggctcaggacggcgagctcctggacacgtctggcccgtactcagagagctcgggcaccagcagccccagcacgtcccccagggcctccaaccactcgctctgctccggcagctctgcctccaaggctggcagcagcccctccctggaacaagacgatggagatgaggaaaccagcgtggtgatagttgggaaaatttccttctgtcccaaggatgtcctgggccatggagctgagggcacaattgtgtaccggggcatgtttgacaaccgcgacgtggccgtgaagaggatcctccccgagtgttttagcttcgcagaccgtgaggtccagctgttgcgagaatcggatgagcacccgaacgtgatccgctacttctgcacggagaaggaccggcaattccagtacattgccatcgagctgtgtgcagccaccctgcaagagtatgtggagcagaaggactttgcgcatctcggcctggagcccatcaccttgctgcagcagaccacctcgggcctggcccacctccactccctcaacatcgttcacagagacctaaagccacacaacatcctcatatccatgcccaatgcacacggcaagatcaaggccatgatctccgactttggcctctgcaagaagctggcagtgggcagacacagtttcagccgccgatctggggtgcctggcacagaaggctggatcgctccagagatgctgagcgaagactgtaaggagaaccctacctacacggtggacatcttttctgcaggctgcgtcttttactacgtaatctctgagggcagccacccttttggcaagtccctgcagcggcaggccaacatcctcctgggtgcctgcagccttgactgcttgcacccagagaagcacgaagacgtcattgcacgtgaattgatagagaagatgattgcgatggatcctcagaaacgcccctcagcgaagcatgtgctcaaacacccgttcttctggagcctagagaagcagctccagttcttccaggacgtgagcgacagaatagaaaaggaatccctggatggcccgatcgtgaagcagttagagagaggcgggagagccgtggtgaagatggactggcgggagaacatcactgtccccctccagacagacctgcgtaaattcaggacctataaaggtggttctgtcagagatctcctccgagccatgagaaataagaagcaccactaccgggagctgcctgcagaggtgcgggagacgctggggtccctccccgacgacttcgtgtgctacttcacatctcgcttcccccacctcctcgcacacacctaccgggccatggagctgtgcagccacgagagactcttccagccctactacttccacgagcccccagagccccagcccccagtgactccagacgccctctgagcgagggcggcccctctgttctggtggccccagctgtgactgagggcctggtcaccacaattagagcttgatgcctcccggctttgcagggagaccaggcttcccaaaccaagtgccttgagctgcctgctctgcagcccacagaggacagtgctgaccccaggaagtgggagaagtggcccctcgtgacctacagggaactgggaagatgctggccccaaaagccttacggtcatgatgtctgcaaaggagggcctcagagacagcgcgagtagcacccccagccatctactggataaacttgcttcagactttttaaattcctgcttaatgtcagtctacaggcctttcaggaagggagaggagggaatcgtacattttgcttgcgtgctgggacagctaggctgagatgcaccaagtacagccttcactggagaccggaattgagaggtgggggatgctgaggagggggaggacggagttcagagggtgtcgtcctgcagtgtgagatttctcattgatcacagatgtgcccagagtagcccaggtcactgttaactagtgtttctgcagaggcagcaggagccatgagcatgaggtgtggcattagggactggtcagctatgcatgctggcaggtggggttgtgtctgcaggtctcagaaatgaagaggctgctctgttctggaggcagccgtggcccagtgccagtggccagaacagtggcctttggtgggtgtgtcccgggccatctcggggtggtgctcaggagcgcctggggcaagaggtaaagagttccctggccttcaaggagagcagcgaagacccagacaggggccagccttcaggaccagagggaggccgccgaatgggaccctcctggtcaccaggagaaagccctgggccagcgagtaggcagtcaaactccttcgtccccaaggccggtggaacaagaggct

SEQ ID NO: 2073 - DNA, 2881 bp, Homo sapiens
ggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaata

SEQ ID NO: 2074 - DNA, 450 bp, Homo sapiens
ctgctccacagccaatggagagaaagacagcatcacccttatctccatgaagaacatcaacatgaataatggcaaacaaagtctctcagcagagaaggttctttaaaagcaactttgggtccccatgagtccaaggatgatgcagctgccctgtgactacaaggaggaagagatggaattagtagaggcaatgaaccacatgtaaattattttattgtttcatgtctgcttctagatctaaaggacactagcattgccccagatctgggagcaagctaccaacaggggagactctttcctgtatggacagctgctgtggaaatactgcctgcttctcccacctcctcagagccacaggaaagaggaggtgacagagagagagcaaggaaagtgatgaggtggattgatactttctactttgcattaaaattattttctagcctgcagtct

SEQ ID NO: 2075 - DNA, 290 bp, Homo sapiens
actccctctctcttctccactatggacagagcctccactgagctgctgcctgcccgccacatacccagctgacatgggcaccgcaggagccatgcagctgtgctgggtgatcctgggcttcctcctgttccgaggccacaactcccagcccacaatgacccagacctctagctctcagggaggccttggcggtctaagtctgaccacagagccagtttcttccaacccaggatacatcccttcctcagaggctaacaggccaagccatctgtccagcactggtaccccag

SEQ ID NO: 2076 - DNA, 1823 bp, Homo sapiens
attggctgaagggccggcggctctggctgcccggcggttgagagcatggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgccatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccagacctcccacctcaccttgcttccttcaggactcagatcatgaggacttccttagtgccattcagctctgaggccagagcatggtcctccacccttcctgccattctgccctgggctcctcaggtagttggaattcctgacttaggacttggggttgggtccaaggtgcttacatcccaggggcctcatgcctaagatagagggtgggagcgaacccacatgaaccaatacagcccagctccaactagatccagattccaggtttcttgcttctttcttgggttcctcagttctctcctgggttccccaacctcctctgccaccacaccaaaccaccagtgatgcatcccctggggcaaagctcatcataacccctctgcacaccagccagcctggagaccgttgttcctggggcctgttactgatcctcatctagccttgatttatccacaggagactgcaggctttgaacctagattgctttatgtttctcaccctagctccatccccaacactggtgaccagtcacgcctgggttgtatctctacccaaggaggccacatcataatgaggttcccaggccagcctggcctgtctgtcttacttggcaaccgtccctcaccagcaacatgcacctgagattcccaagtacctgccccccctcccattttggcctggctcctgagacctaagcagcggccacacacacacagagggggtctgtgtttattcacacactcctggtacagtgaggatggaggaacatttacgaagggcacccctgggttgagaacatctccggggccacagatgtcatccaaaggttcagagcagtccccatttgggttcccaggggcaagacgcaggggtccaaggtaaaatcggatctgggcccttggaaggtgatgataccttggggagaaggggtctgccagaaagcctcctggggtcaggcctgggcagactggccatgtggttggtaaccgtgtcgggggcttgtctcatcccagcctcaacacccatcctatctgccaggcgcagaagagcgtggccgagactgaggggagggcaggaaccatga

SEQ ID NO: 2077 - DNA, 3147 bp, Homo sapiens
ggggggcggccgcggccgagcgggggtgctgcgcggcggccgtgatggctggtgacggcggggccgggcaggggaccggggccgcggcccgggagcgggccagctgccgggagccctgaatcaccgcctggcccgactccaccatgaacgtcgcgctgcaggagctgggagctggcagcaacgtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgccgactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccggcaaagcaaagaaattgcagaggggatgatcagcgaaatccggaccgcatttgaggaggccctgggacagctggtttggatggatgagaagacccgccaggcagccaaggagaaagcagatgccatctatgatatgattggtttcccagactttatcctggagcccaaagagctggatgatgtttatgacgggtacgaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatggccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcccccaccattcactgtgacatctttccgtgtcaccctgcctggaagaggtctgggtggggaggccagttcccataggaaggagtctgcctcttctgtccccaggctcactcagcctggcggccatggggcctgccgtgcctgccccactgtgacccacaggcctgggtggtgtacctcctggacttctccccaggctcactcagtgcgcacttaggggtggactcagctctgtctggctcaccctcacgggctacccccacctcaccctgtgctccttgtgccactgctcccagtgctgctgctgaccttcactgacagctcctagtggaagcccaagggcctctgaaagcctcctgctgcccactgtttccctgggctgagaggggaagtgcatatgtgtagcgggtactggttcctgtgtcttagggcacaagccttagcaaatgattgattctccctggacaaagcaggaaagcagatagagcagggaaaaggaagaacagagtttatttttacagaaaagagggtgggagggtgtggtcttggcccttataggaccctgtgccaataaacagacatgcatccgtca

SEQ ID NO: 2078 - DNA, 3445 bp, Homo sapiens
atggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgccatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgccgactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccggcaaagcaaagaaattgcagaggggatgatcagcgaaatccggaccgcatttgaggaggccctgggacagctggtttggatggatgagaagacccgccaggcagccaaggagaaagcagatgccatctatgatatgattggtttcccagactttatcctggagcccaaagagctggatgatgtttatgacgggtacgaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatggccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcccccaccattcactgtgacatctttccgtgtcaccctgcctggaagaggtctgggtggggaggccagttcccataggaaggagtctgcctcttctgtccccaggctcactcagcctggcggccatggggcctgccgtgcctgccccactgtgacccacaggcctgggtggtgtacctcctggacttctccccaggctcactcagtgcgcacttaggggtggactcagctctgtctggctcaccctcacgggctacccccacctcaccctgtgctccttgtgccactgctcccagtgctgctgctgaccttcactgacagctcctagtggaagcccaagggcctctgaaagcctcctgctgcccactgtttccctgggctgagaggggaagtgcatatgtgtagcgggtactggttcctgtgtcttagggcacaagccttagcaaatgattgattctccctggacaaagcaggaaagcagatagagcagggaaaaggaagaacagagtttatttttacagaaaagagggtgggagggtgtggtcttggcccttataggaccctgtgccaataaacagacatgcatccgtca

SEQ ID NO: 2079 - DNA, 3229 bp, Homo sapiens
gcggccgcggccgagcgggggtgctgcgcggcggccgtgatggctggtgacggcggggccgggcaggggaccggggccgcggcccgggagcgggccagctgccgggagccctgaatcaccgcctggcccgactccaccatgaacgtcgcgctgcaggagctgggagctggcagcaacatggtggagtacaaacgggccacgcttcgggatgaagacgcacccgagacccccgtagagggcggggcctccccggacgccatggaggtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgccgactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccggcaaagcaaagaaattgcagaggggatgatcagcgaaatccggaccgcatttgaggaggccctgggacagctggtttggatggatgagaagacccgccaggcagccaaggagaaagcagatgccatctatgatatgattggtttcccagactttatcctggagcccaaagagctggatgatgtttatgacgggtacgaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatggccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcccccaccattcactgtgacatctttccgtgtcaccctgcctggaagaggtctgggtggggaggccagttcccataggaaggagtctgcctcttctgtccccaggctcactcagcctggcggccatggggcctgccgtgcctgccccactgtgacccacaggcctgggtggtgtacctcctggacttctccccaggctcactcagtgcgcacttaggggtggactcagctctgtctggctcaccctcacgggctacccccacctcaccctgtgctccttgtgccactgctcccagtgctgctgctgaccttcactgacagctcctagtggaagcccaagggcctctgaaagcctcctgctgcccactgtttccctgggctgagaggggaagtgcatatgtgtagcgggtactggttcctgtgtcttagggcacaagccttagcaaatgattgattctccctggacaaagcaggaaagcagatagagcagggaaaaggaagaacagagtttatttttacagaaaagagggtgggagggtgtggtcttggcccttataggaccctgtgccaataaacagacatgcatccgtca

SEQ ID NO: 2080 - DNA, 2667 bp, Homo sapiens
ggtgctgcgcggcggccgtgatggctggtgacggcggggccgggcaggggaccggggccgcggcccgggagcgggccagctgccgggagccctgaatcaccgcctggcccgactccaccatgaacgtcgcgctgcaggagctgggagctggcagcaacatggtggagtacaaacgggccacgcttcgggatgaagacgcacccgagacccccgtagagggcggggcctccccggacgccatggaggtgggcaagggggcttcccctttctcaccaggccccagccctggcatgacgcctggcacacccaggagctctgggctgttctggagggtcacctgcccccacctccgctccatctctggcctctgctctaggactatggtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgccgactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccggcaaagcaaagaaattgcagaggggatgatcagcgaaatccggaccgcatttgaggaggccctgggacagctggtttggatggatgagaagacccgccaggcagccaaggagaaagcagatgccatctatgatatgattggtttcccagactttatcctggagcccaaagagctggatgatgtttatgacgggtacgaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatggccagctgtcaccagacctggggcagctctcctgacaaagctgtttgctcttgggttgggaggaagcaaatgcaagctgggctgggtctag

SEQ ID NO: 2081 - DNA, 1126 bp, Homo sapiens
agccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattag

SEQ ID NO: 2082 - DNA, 1509 bp, Homo sapiens
gaaggcttcgcccgacgccggaactgcgagctctcagcgggagccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctgagtcttggtatcattggctctcagcccctgacctctctcagttatcaggcactcattagagatgtcagaagattttaagatacccctagtttcttcctgtgaacaacagaggtaataaataaactctgacatcggttgaacatgtgtcaggggtcagactgcagatcccagtctctgccagttacttgctgtataaccgtggacaaattgtttaaatgctctgggcctcagcttcctcac

SEQ ID NO: 2083 - DNA, 1676 bp, Homo sapiens
aatttgcggacttgggcatgggactgagtcaacctgtccccatctctgatcctgtgcttaggttctgtacggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagacaaagctgaggaccctgggagataataataaggggtctttgaaggccaaaggattgggaaacactcctctgggcacctgctggatttcagccctgggaagacctgaaatgtccatcctgatttttcgtaggaggagaaacagcctagaagggatgataagggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcaca

SEQ ID NO: 2084 - DNA, 1187 bp, Homo sapiens
agaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcatttt

SEQ ID NO: 2085 - DNA, 702 bp, Homo sapiens
cggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggtggacattgcatctgggatggccattgaagggatgtgctatgcccag

SEQ ID NO: 2086 - DNA, 1649 bp, Homo sapiens
cgtgccggggcggggcgtagtacggactgggcctggcctggggcgtccccgcgaagcctgggcctgtcaggcggttccgtccgggtctcggccaccgtcgagttccgtcgagttccgtcccggccctgctcacagcagcgccctcggagcgcccagcacctgcggccggccaggcagcgcgatcctgcggcgtctggccatcccgaatgctatggccgccgtcgccgtcttgcgggccttcggggcaagtgggcccatgtgtctccggcgcggcccctgggcccagctccccgcccgcttctgcagccgggacccggccggggcggggcggcgggagtcggagccgcggcccaccagcgcgcggcagctggacggcataaggaacatcgtcttgagcaatcccaagaagaggaacgcgttgtcacttgcaatgctgaagtctctccaaagtgacattcttcatgacgctgacagcaacgatctgaaagtcattatcatctcggctgaggggcctgtgttttcttctgggcatgacttaaaggagctgacagaggagcaaggccgtgattaccatgccgaagtatttcagacctgttccaaggtcatgatgcacatccggaaccaccccgttcccgtcattgccatggtcaatggcctggccgcggctgccggctgtcaactggttgccagctgcgacattgccgtggcgagcgacaagtcctcttttgccactcctggggtgaacgtcgggctcttctgttctacccctggggttgccttggcaagagcagtgcctagaaaggtggccttggagatgctctttactggtgagcccatttctgcccaggaggccctgctccacgggctgcttagcaaggtggtgccagaggcggagctgcaggaggagaccatgcggatcgctaggaagatcgcatcgctgagccgtccggtggtgtccctgggcaaagccaccttctacaagcagctgccccaggacctggggacggcttactacctcacctcccaggccatggtggacaacctggccctgcgggacgggcaggagggcatcacggccttcctccagaagagaaaacctgtctggtcacacgagccagtgtgagtggaggcagaggagtgaggcccacgggcagcgcccaggagcccaccttcccctctggcccagccaccactgcctctcagcttcaacaggtgacaggctgctttcgtgacttgatattggtgtcatagcatttggcctacattaaaagccacaatttcatggggaaaggacaaaatggagagtgactgaggtgctgacctcagtgcaaggctggtgaaccctgcagcgggccagctatggtgggaagcctggcatttggggtgctccttgcaacgtcttaagcaagcgaccccccgacatagcaaaaggtggcaacccatggaggcagaaagaaggacgccagcctgacccttatctgaaacgtcctaagcagagttaatcctggctgctcaggagaggcgacacatttcaaatctccacgagatattctccacacagaaaatcttcttgattctatagagacttaatcatgcctatggctttgaataatcttatgtgatttaaataaattaaatctttatagaga

SEQ ID NO: 2087 - DNA, 854 bp, Homo sapiens
ccgggtctcggccaccgtcgagttccgtcgagttccgtcccggccctgctcacagcagcgccctcggagcgcccagcacctgcggccggccaggcagcgcgatcctgcggcgtctggccatcccgaatgctatggccgccgtcgccgtcttgcgggccttcggggcaagtgggcccatgtgtctccggcgcggcccctgggcccagctccccgcccgcttctgcagccgggacccggccggggcggggcggcgggagtcggagccgcggcccaccagcgcgcggcagctggacggcataaggtcagccccgggccgcgcgggctcctcgcgttggtgccgagtcggggtcagggcgccgccattgacccggggaggacccggggaaccggagccccgtttacgcccctggggagggaactccccgtgtcccggacccgggcctggcagcgagacgcgcaggaacatcgtcttgagcaatcccaagaagaggaacgcgttgtcacttgcaatgctgaagtctctccaaagtgacattcttcatgacgctgacagcaacgatctgaaagtcattatcatctcggctgaggggcctgtgttttcttctgggcatgacttaaaggagctgacagaggagcaaggccgtgattaccatgccgaagtatttcagacctgttccaaggtcatgatgcacatccggaaccaccccgttcccgtcattgccatggtcaatggcctggccgcggctgccggctgtcaactggttgccagctgcgacattgccgtggcgagcgacaagtcctcttttgccactcctggggtgaacgtcgggctcttctgttctacccctggggtt

SEQ ID NO: 2088 - DNA, 623 bp, Homo sapiens
tagacaggaatcgcaggggtcctcacttgttttgactggtgtgtgaccctgtgattgtaaaatgttcttcacaggaacatcgtcttgagcaatcccaagaagaggaacgcgttgtcacttgcaatgctgaagtctctccaaagtgacattcttcatgacgctgacagcaacgatctgaaagtcattatcatctcggctgaggggcctgtgttttcttctgggcatgacttaaaggagctgacagaggagcaaggccgtgattaccatgccgaagtatttcagacctgttccaaggtcatgatgcacatccggaaccaccccgttcccgtcattgccatggtcaatggcctggccgcggctgccggctgtcaactggttgccagctgcgacattgccgtggcgagcgacaagtcctcttttgccactcctggggtgaacgtcgggctcttctgttctacccctggggttgccttggcaagagcagtgcctagaaaggtggccttggagatgctctttactggtgagcccatttctgcccaggaggccctgctccacgggctgcttagcaaggtggtgccagaggcggagctgcaggaggagaccatgcggatcgctaggaagat

SEQ ID NO: 2089 - DNA, 1541 bp, Homo sapiens
aggaggcgagctcagcccgcgacctttatcccgcgcgttgcggtcaagatggcgctggtggcttctgtgcgagtcccggcgcgcgttctgctccgcgcgggggcccggctcccgggcgcggccctcgggcggacggagcgggcggccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaagtactgccagcgtttcattttgctgatgttacgtagaagttcctgttcctcatagcccagtggcccaaggcccagccacacacaaacacacatgggtgcctgtgcccgtcaggcaaggggagttggagggcagccttttgacttgggattgtgactggcaggggatgccattctggacctggtgaggttgccacggagtgtctctgttcccaaggcagaatcgtaagtcaagtccctggtcatccattctggcctttggactgcctgctcttaggtgtaaggccaggtggtcttggcccccatgacccacacagaactccccagggaaaagccctttggtcactgcccttactcatcaggatgaagagcgcacagtgaatcagagcaactgggggatcctgagccagcgggagtgggactctggaggcagctgtgctgccagggatccaaatgtcccttaagaaggattttgcaagaaccaaactcatccaaacccttga

SEQ ID NO: 2090 - DNA, 948 bp, Homo sapiens
gtcaagatggcgctggtggcttctgtgcgagtcccggcgcgcgttctgctccgcgcgggggcccggctcccgggcgcggccctcgggcggacggagcgggcggccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaa

SEQ ID NO: 2091 - DNA, 1380 bp, Homo sapiens
acccccgagcccccgcagccctagagccgcccaagggatggcgatggcgtacttggcttggagactggcgcggcgttcgtgtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaa

SEQ ID NO: 2092 - DNA, 1407 bp, Homo sapiens
acccccgagcccccgcagccctagagccgcccaagggatggcgatggcgtacttggcttggagactggcgcggcgttcgtgtccgagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaagcttaagaattcacaca

SEQ ID NO: 2093 - DNA, 1405 bp, Homo sapiens
ggataccgctgtccaggcgaaggtcgccgccgttggaagaccctccttccctattgtctaggtggcaacaggattttgctttgctggttttccggtgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaagcttaagaattca

SEQ ID NO: 2094 - DNA, 1402 bp, Homo sapiens
acccccgagcccccgcagccctagagccgcccaagggatggcgatggcgtacttggcttggagactggcgcggcgttcgtgtccgagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaagcttaagaattc

SEQ ID NO: 2095 - DNA, 1548 bp, Homo sapiens
gcgatggcgtacttggcttggagactggcgcggcgttcgtgtccgaggtaagcttggagtcccggccgttcggcccatggtcgcccgcaggataccgctgtccaggcgaaggtcgccgccgttggaagaccctccttccctattgtctaggtggcaacaggattttgctttgctggttttccggtgaggtagtgctaaaaagtgacgacctcacgcgcgccctcctgcaccgctgggcccggagtgttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaaca

SEQ ID NO: 2096 - DNA, 6346 bp, Homo sapiens
ctgggatagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaatatctgcagcgttgcttggtgcacagattgctgaaactgtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagaccatgcctaggaacattttttaaggactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaagggagtagattctgctatcttggcctcacagcccttcctgttgattacaaagcccgtggaagaaaacagaacacaccctcctcagttccgtctaaatgtgtttcttctgcttcaattacaccagttctggggcaaagacactgatgaaacaacacccatacctgaaaagaataaatgtgtgactttcaaatcccctttcgcagtgaaagaaacagcaaacacttaagattcagcatctgttctccagttgcactgaggaatgcactgtctcgcagcaccagctctgcagagcccttgccccagactctttgcggttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtctgtatgcgtgcctgtctgtgtgcgggtgtgtgtatgtgcgtagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggaaaaaaaatagattctgaaccatttattgttgaataagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcagggtctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttgccgtatacaaccctgc

SEQ ID NO: 2097 - DNA, 3045 bp, Homo sapiens
attccactgggatagaagcggcaggagcagcgttggcaccggcgaaccatggctgggattttctatttcgccctattttcgtgtctcttcgggatttgcgacgctgtcacaggttccagggtataccccgcgaatgaagtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaatt

SEQ ID NO: 2098 - DNA, 3454 bp, Homo sapiens
agaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggagtaagtactcaacgatgtaacacgaaaggggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaatatctgcagcgttgcttggtgcacagattgctgaaactgtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagac

SEQ ID NO: 2099 - DNA, 3363 bp, Homo sapiens
acgcgtgctcatcttgtgtaaaagtaaaagttgctcatgtcattagctcggctctgagtttgcatgagaaaccagcgcagctctcgagccacgggagaaaacacgatctgctgcggagcccagtgacctgaaactgtagcagtgactcgagacctgtcctctcctcgacgtcgccctataaccctcccgctttatttaggatccgcttttccgagagcagccactcaggcaacccccggaagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaa

SEQ ID NO: 2100 - DNA, 617 bp, Homo sapiens
agctcggctctgagtttgcatgagaaaccagcgcagctctcgagccacgggagaaaacacgatctgctgcggagcccagtgacctgaaactgtagcagtgactcgagacctgtcctctcctcgacgtcgccctataaccctcccgctttatttaggatccgcttttccgagagcagccactcaggcaacccccggaaggtttgttaggagtttctccttgaaacgctttccgattccatcttttgaaatccagcaggcgagagtcacgacagactccaggacctcttgagcgctgtccgcagccccacgaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgaga

SEQ ID NO: 2101 - DNA, 558 bp, Homo sapiens
accggccgggcccgcccccttggcaatgtcttcagcccgctgctctcctaacttaagcatttattccactgggatagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctg

SEQ ID NO: 2102 - DNA, 1885 bp, Homo sapiens
gagacttgcaggcagcaaacacggtgcgagcgaacaggagtgggggggaaattaaaaaaagctaaacgtggagcagccgatcggggaccgagaaggggaatcgatgcaaggagcacaataaaacaaaagctacttcggaacaaacagcatttaaaaatccacgactcaagataactgaaacctaaaataaaacctgctcatgcaccatggtttttcaaactcggtacccttcatggattattttatgctacatctggctgctccgctttgcacacacaggggaggcgcaggctgcgaaggaagtactactgctggattctaaagcacaacaaacagagttggagtggatttcctctccacccaatgggtgggaagaaattagtggtttggatgagaactataccccgatacgaacataccaggtgtgccaagtcatggagcccaaccaaaacaactggctgcggactaactggatttccaaaggcaatgcacaaaggatttttgtagaattgaaattcaccctgagggattgtaacagtcttcctggagtactgggaacttgcaaggaaacatttaatttgtactattatgaaacagactatgacactggcaggaatataagagaaaacctctatgtaaaaatagacaccattgctgcagatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtgtactacaagaagtgctggtccattattgagaacttagctatctttccagatacagtgactggttcagaattttcctctttagtcgaggttcgagggacatgtgtcagcagtgcagaggaagaagcggaaaacgcccccaggatgcactgcagtgcagaaggagaatggttagtgcccattggaaaatgtatctgcaaagcaggctaccagcaaaaaggagacacttgtgaacgtaagtaatgtgtcctattaaaactccactttgcctttttaaatttcagtatcagacattttaaactttaatagttatttgaatacgtgaatctgctctgtaccagaagcgcaattcagtagatcttaaacaaagtcaccgttgaacttagtgattgccctacagtagcatctgcactaagtgtatgtaatcaatataggtgataatgaaatttgttactaaaatttaatgtgtcctatgcttaacatggaagtcaatagttgcacgttgggctatggagtttagagaggagtctgggtagttggacatatagcctggcaagactgaggtgacatttaacaggatttaatgagatgccattcctcctgtttttaaacccatattgtctgggcccttgagtagcagtaaataggaggttaagagggctgtgaataagagctctagtgacaggcagggcataaacgaatatatttacaaacttttagaattatcttatataaatactataactttaatacaaaattttcaaatttcacttacaaaatctctgtggttacttctgagaaaggtgtgtgttttttttttttttttttggactaagtaccaaaatgaccacatttttgtgaaagtgggccaaagtaaagttttaattattatagtacaccaattgcatgttttgaaacaatcatgtatgaattagtaaacttttttctttgttttataaaaccgttttttttctttcctagcattatgtggctaaatatttaaaactatgtcatatggaccttcaagattgatagatattctgtttctaggtttcatgaaaataaattataaagttatgtta

SEQ ID NO: 2103 - DNA, 6588 bp, Homo sapiens
cggtgcgagcgaacaggagtgggggggaaattaaaaaaagctaaacgtggagcagccgatcggggaccgagaaggggaatcgatgcaaggagcacaataaaacaaaagctacttcggaacaaacagcatttaaaaatccacgactcaagataactgaaacctaaaataaaacctgctcatgcaccatggtttttcaaactcggtacccttcatggattattttatgctacatctggctgctccgctttgcacacacaggggaggcgcaggctgcgaaggaagtactactgctggattctaaagcacaacaaacagagttggagtggatttcctctccacccaatgggtgggaagaaattagtggtttggatgagaactataccccgatacgaacataccaggtgtgccaagtcatggagcccaaccaaaacaactggctgcggactaactggatttccaaaggcaatgcacaaaggatttttgtagaattgaaattcaccctgagggattgtaacagtcttcctggagtactgggaacttgcaaggaaacatttaatttgtactattatgaaacagactatgacactggcaggaatataagagaaaacctctatgtaaaaatagacaccattgctgcagatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtgtactacaagaagtgctggtccattattgagaacttagctatctttccagatacagtgactggttcagaattttcctctttagtcgaggttcgagggacatgtgtcagcagtgcagaggaagaagcggaaaacgcccccaggatgcactgcagtgcagaaggagaatggttagtgcccattggaaaatgtatctgcaaagcaggctaccagcaaaaaggagacacttgtgaaccctgtggccgtgggttctacaagtcttcctctcaagatcttcagtgctctcgttgtccaactcacagtttttctgataaagaaggctcctccagatgtgaatgtgaagatgggtattacagggctccatctgacccaccatacgttgcgtgcacaaggcctccatctgcaccacagaacctcattttcaacatcaaccaaaccacagtaagtttggaatggagtcctcctgcagacaatgggggaagaaacgatgtgacctacagaatattgtgtaagcggtgcagttgggagcagggcgaatgtgttccctgtgggagtaacattggatacatgccccagcagactggattagaggataactatgtcactgtcatggacctgctagcccacgctaattatacttttgaagttgaagctgtaaatggagtttctgacttaagccgatcccagaggctctttgctgctgtcagtatcaccactggtcaagcagctccctcgcaagtgagtggagtaatgaaggagagagtactgcagcggagtgtcgagctttcctggcaggaaccagagcatcccaatggagtcatcacagaatatgaaatcaagtattacgagaaagatcaaagggaacggacctactcaacagtaaaaaccaagtctacttcagcctccattaataatctgaaaccaggaacagtgtatgttttccagattcgggcttttactgctgctggttatggaaattacagtcccagacttgatgttgctacactagaggaagctacaggtaaaatgtttgaagctacagctgtctccagtgaacagaatcctgttattatcattgctgtggttgctgtagctgggaccatcattttggtgttcatggtctttggcttcatcattgggagaaggcactgtggttatagcaaagctgaccaagaaggcgatgaagagctttactttcattttaaatttccaggcaccaaaacctacattgaccctgaaacctatgaggacccaaatagagctgtccatcaattcgccaaggagctagatgcctcctgtattaaaattgagcgtgtgattggtgcaggagaattcggtgaagtctgcagtggccgtttgaaacttccagggaaaagagatgttgcagtagccataaaaaccctgaaagttggttacacagaaaaacaaaggagagactttttgtgtgaagcaagcatcatggggcagtttgaccacccgaatgttgtccatttggaaggggttgttacaagagggaaaccagtcatgatagtaatagagttcatggaaaatggagccctagatgcatttctcaggaaacatgatgggcaatttacagtcattcagttagtaggaatgctgagaggaattgctgctggaatgagatatttggctgatatgggatatgttcacagggaccttgcagctcgcaatattcttgtcaacagcaatctcgtttgtaaagtgtcagattttggcctgtcccgagttatagaggatgatccagaagctgtctatacaactactggtggaaaaattccagtaaggtggacagcacccgaagccatccagtaccggaaattcacatcagccagtgatgtatggagctatggaatagtcatgtgggaagttatgtcttatggagaaagaccttattgggacatgtcaaatcaagatgttataaaagcaatagaagaaggttatcgtttaccagcacccatggactgcccagctggccttcaccagctaatgttggattgttggcaaaaggagcgtgctgaaaggccaaaatttgaacagatagttggaattctagacaaaatgattcgaaacccaaatagtctgaaaactcccctgggaacttgtagtaggccaataagccctcttctggatcaaaacactcctgatttcactaccttttgttcagttggagaatggctacaagctattaagatggaaagatataaagataatttcacggcagctggctacaattcccttgaatcagtagccaggatgactattgaggatgtgatgagtttagggatcacactggttggtcatcaaaagaaaatcatgagcagcattcagactatgagagcacaaatgctacatttacatggaactggcattcaagtgtgatatgcatttctcccttttaagggagattacagactgcaagagaacagtactggccttcagtatatgcatagaatgctgctagaagacaagtgatgtcctgggtccttccaacagtgaagagaagatttaagaagcacctatagacttgaactcctaagtgccaccagaatatataaaaagggaatttaggatccaccatcggtggccaggaaaatagcagtgacaataaacaaagtactacctgaaaaacatccaaacaccttgagctctctaacctcctttttgtcttatagactttttaaaatgtacataaagaatttaagaaagaatatatttgtcaaataaaatcatgatcttattgttaaaattaatgaaatattttccttaaatatgtgatttcagactattcctttttaaaatcatttgtgtttattcttcataaggactttgttttagaaagctgtttatagctttggacctttttagtgttaaatctgtaacattactacactgggtacctttgaaagaatctcaaatttcaaaagaaatagcatgattgaagatacatctctgttagaacattggtatcctttttgtgccattttattctgtttaatcagtgctgttttgatattgtttgctaattggcaggtagtcaagaaaatgcaagttgccaagagctctgatattttttaaaaagaatttttttgtaaagatcagacaacacactatcttttcaatgaaaaaagcaataatgatccatacatactataaggcacttttaacagattgtttatagagtgattttactagaaagaatttaataaactcgaagtttaggtttatgagtatataaacaaatgaggcacttcatctgaagaatgttggtgaaggcaagtctctgaaagcagaactatccagtgttatctaaaaattaatctgagcacatcaagattttttcattctcgtgacattaggaaatttaggataaatagttgacatatattttatatcctcttctgttgaatgcagtccaaacatgaaaggaaataattgttttatattataactctgaagcatgataaaggggcagttcacaattttcaccatttaaacacaaatttgctgcacagaatatcaccattgcagttcaaaacaaaacaaaacaaaaagtcttttgtttgtgaacactgatgcaagaaacttgttaaatgaaaggactctttaccctagaaggaagaggtgaaggatctggcttgtttttaaagctttatttattaaaccatattatttgattactgtgttagaatttcataagcaataattaaatgtgtctttatagatattgcaggaatgtatacatattgtgattaatgctttcaaaacttatgaaaatcatgaactaccccagaattgaactgttgtacttccaaagagaattgggctgtttataatgattttaatagagaaagatcccagggatcggtcataattggtcttgtttgataatgtgggcatccacaaacaaacaaacaaataacagaaacaaaatctgtaaatgttcctttgtaaaacttgtaaattttatttatactgtcttgttttgtacacacatttctctgtagtgggctctgaatacattgaaaatgcactatatttttctattttacttgcagagcatcacaaaagaacaggtattttcagtgctacataatgtgttttcccacatttaggaccaaagacggctatagaaaaactcaaatggattgcttcccaaacccctccccaccctttttttttggttttaaatcactgtacagtgttatttgatattttaatttattttttgattgactagaaaaatcattttaatttcactaaaatgttttttgtccctaaggaaaagtaatctgtaaaaataattttaattagcataatacagtcacctagacacttccatttgtaatctttgtaatagactgtaaatatatttttggaactataacacaatgtgcttgagggttatttttcagtgtctgcagtgtgtacaagtgtttatactaagtccagcactttacaattctaatcagtagcattggcctttgtgagaatgagtgaaagagtttgagtgagtgttcttaattccttttggattctagactcactaataatgaagttcttttcttgttcatagcttaaggtgcttattttttctattaaaattaaattaacaaaagccattctagaaatagaagacatagtatggtacatgcaaacggtgtctttcctgcttttttctagcactagatttatagttgagtagtctttcttgagtagaagggcagaataaaagtttttttgagtttttttcaaaaataaatttttccttcagcaatatacctcatctgccttaaattttttacagctctttacagggaaaggggagaagggatgggaaagacacacagcacaataggaagtgtatgattacatcactatctcgtttgtaagtttcttttcctaatcaacattatgatttcgaaatacatgtatgtgaaacaaatattaagagaaaaagaattaacattgtaatgctgattgtaatactctcttccagaaagagatgagatggtataacgataagaatgtacaacttgcaccttgaaatctttttttttaaataaattagtgctcaggggaggaaaagtagagaaagtgaacgtcaaaaatagaattccaaaattataaaaatgcaaaaggaaatggcctccttgctttaatagagccaccttttttagaacactgtcctcacacttgacctgtgttttgcattcagtactgaaataaaagtaacttgttctacatttgaatctaacattttctcagcaattgatctggtccttgtttactagaactggtggtttatgcttgtcagagcactattagttgaatcatattgtatacttatgtaatctacattagctagtactgtttaggactatattttaattgctcttcttatccgtgtttttaagacaattaaaatggtgtgattcacctctcttttttatttaggtaatgctgatattctcccttttgtttcttgagtagcctagaactatgctactcactgatgtgcatgttcaaataaattactgatgtgtatttttttgctatatgtggagaaatcatggggaactcggggcgagatgtgcttttcgttggttgaatttgtccctccttgcctaagaaatactacaggggtcatccttttataaggacaaactgcttttgaacagtgtcttcaatgtatcaagcacaaataactctttcttcaacatgaatcataagtctctttttaccagcttaaaataataaacaagtctattagacaatgtaaagaaaa

SEQ ID NO: 2104 - DNA, 5335 bp, Homo sapiens
gcttctctccatcttgtgattcctttttcctcctgaaccctccagtgggggtgcgagtttgtctttatcaccccccatcccaccgccttcttttcttctcgctctcctacccctccccagcttggtgggcgcctctttcctttctcgcccactttcatttttatttattcatatttatttggcgcccgctctctctctgtccctttgcctgcctccctccctccggatccccgctctctccccggagtggcgcgtcgggggctccgccgctggccaggcgtgatgttgcacgtggagatgttgacgctggtgtttctggtgctctggatgtgtgtgttcagccaggacccgggctccaaggccgtcgccgaccgctacgctgtctactggaacagcagcaaccccagattccagaggggtgactaccatattgatgtctgtatcaatgactacctggatgttttctgccctcactatgaggactccgtcccagaagataagactgagcgctatgtcctctacatggtgaactttgatggctacagtgcctgcgaccacacttccaaagggttcaagagatgggaatgtaaccggcctcactctccaaatggaccgctgaagttctctgaaaaattccagctcttcactcccttttctctaggatttgaattcaggccaggccgagaatatttctacatctcctctgcaatcccagataatggaagaaggtcctgtctaaagctcaaagtctttgtgagaccaacaaatagctgtatgaaaactataggtgttcatgatcgtgttttcgatgttaacgacaaagtagaaaattcattagaaccagcagatgacaccgtacatgagtcagccgagccatcccgcggcgagaacgcggcacaaacaccaaggatacccagccgccttttggcaatcctactgttcctcctggcgatgcttttgacattatagcacagtctcctcccatcacttgtcacagaaaacatcagggtcttggaacaccagagatccacctaactgctcatcctaagaagggacttgttattgggttttggcagatgtcagatttttgttttctttctttcagcctgaattctaagcaacaacttcaggttgggggcctaaacttgttcctgcctccctcaccccaccccgccccacccccagccctggcccttggcttctctcacccctcccaaattaaatggactccagatgaaaatgccaaattgtcatagtgacaccagtggttcgtcagctcctgtgcattctcctctaagaactcacctccgttagcgcactgtgtcagcgggctatggacaaggaagaatagtggcagatgcagccagcgctggctagggctgggagggttttgctctcctatgcaatatttatgccttctcattcagaactgtaagatgatcgcgcagggcatcatgtcaccatgtcaggtccggaggggaggtattaagaatagatacgatattacaccatttcctataggagtatgtaaatgaacaggcttctaaaaggttgagacactggtttttttttttaatatgactgtcttaaagcattcttgacagcaaaacttgtgctctctaaaagaagccttttttttttttctaggaggcaggttgggtgtggaatgctaatacagagcaggtgtgaaaacagagaaaactacaggtttgctgggggtgtgtatgtgtgagtgcctctaatttttttggtgactgggcagtgcacaccagatattttttctttgaatacagatcaccatggtgctacaactttttttttttttttttttttttttttttttttttttaagaaactcaaagaggcatttttatgaataaagtgaccttccccaaggctgacaagccagggttgatgagtgcatagtggaatagctttggatactcctctgggggatgacatgtaccaaggagaggaccgcagtggccagaggagacatgatttggctttgctggagcgccagtgtgctgtggcctttccccgcctcccaccctagtacccacgttttgctccacactccttgaccgcaggggctcggacacaaacccctgtcaccaggagagtcagtcagcactacttgggagggctaaagggaaatttggaaataaaattccaaagtttggagtaaaaaaattcaagtgttgattttatattctttccctttctgacacagcctaaagcgtagggggaacatgtgtttatctgtgggagataaacaagatggagtcccaaagactttaacaaaatatttttttaaaaatccactagaatagaaaatacattatttagatatactttatgctgagagtgagtatatatgcttgtcctatttaaacttgtgagaaaaagtggtatcccttgatacatttagaaatatgggggctatcttgtttcattgtgggggtggggcagaaggagaataaatgcaggatgaccctgttgaaggaatcttagcatggccaacaggggacgtttccagtcgattaccaggaaatgcaagccttggggtttctactggtggtggggctgtcatgaactttaaaatccaaagcctagacaaggaaaagtgttagaccaattgaaaagcaatccagccctttttttttttttttttttggctttgcacgacatgtcaacagaaaccatgcctttcaatataagaaataaatgtgatgatcatgtaaaatgtgaaaaattgaaagcattccagcaaaataagaattttttatatatttgttttttaagatgtatatgttaaaaaaagagaaggtcgcattatggacagacttcgtgaatgggaatttgcttagaattgtgagtagttctgaattagaaaagtatgtgaaggaaaggcagctgtaaacgtattgtgccctggagagttgtacacatgttgaaatgtaatctgggcttacctgatccatttggagtggatgtcactgccgagtctgttctcacatggaaccatgtgtgtggggttgccagcctcacagatacaatcaatcctattcccctctgacataaggaactcctctggagtggcagagtcttatcacagaaggcagccaccatttcaccaaaacaaaagttcacggcattcaattcctttttcctttagctatttatatatgcagtactctcagtcatatgcagaaatacttttttttttttaattaatagttacaggcttgttggtccagtgggatttgggtagggggagaaagataccttctaaaatggatcaatagaaccaaaataatacagcatgttctataaccacaaggaaatcaaatgatcctgtcatgattccagttagtcataactatgttagcagtgctaaatgcattttagaaatggtgacttctgtggttttcctagcatttgtctctaacaaatggtgaaataattactcatggccctctctgccattgtctttcattttttcacagtgaaattagacccctttacttcaccattctgccactgcaaattaagtataaagaaaatagcaagagtgtccacaccagtagacagtaagcttctctacctgtaagtgatgaaatcatagctaatgcacttgccatggagttttcaagatgattggtgtcagacagttttcactttgtttaaaaagtgttggtggccttttgtggtggtgttacaatcctctgggggcttaggaggatgttgatgcaacttttagaagcttttaatttcaaaaacaactcaaaaatctgaaggacagtcatagctgccactcagccccagttagtcaaaccccagtgacctttgcccctggttgccaagggctttgcaacatcaagcagggaaataaggatctgtctgtttagtggataccgtgtatcctttaatagaccaggtaacagttcgtgttagtttagactattgttttgtactgtactttcttgggtggcagaggaaagaaaagtaaaacattaaaaaaaaaaaaaaaactgcgttctttaaattctgtattattagcaacctctgttgtacatagtgtttgataataaagtattaatttgattcttatgtcttttgtaagtgagaacaatagactttcaggatacaaaacatgcattgaggctttgaaacatccaatgtgtaccatggctgaaaaaaagagtcacaagtggctgagacactgctccatacaggactcatgtgtggtcattgcccacccaatcttatgactccatcatcttgggacctggaacaacatgacttttttgatcgatattttgtcctcggtgttttcaaggtctgatgttggagccctgtggcccaccctcccttctccaccagcatgttggtttgaaaaggatagggaatttagaaacagttctgtactttggtttggtttggttttctgtttgtgattgttttcatggactgttttattttttcccaggaagagtctttatcaatatcatgtgcagctcactcatggaaatggttgcaaaccaatcagtgtaggaagcttaaatggggctgtttccctctctgtgtcgttgtgaaaggaagagtcacacagtacctgtggattttcagggactctgtttttctccggtgccttagcaacggcagcagccatttgtattattttcaaataattagaaaaacagttttcaactcctcctttccattcattgctctcagagttgtggtcactgacttttcttttgaaaaccgcctccaccaacacccccgtttgcctacaccaccccccttttacttagtatgtttattttttgtgtgtctcttgccttcctcccacgttttatttcccctcagagctgtgaatgggcaggtctgtctctggtttggcatcactgagtttttcccatgcattggccccagggctgctaggatgtgagacaaatctccctacaatgggcttgctcccattgtctgtacagtttaatagatgctggcatgtcggaggttacccatgagtcaaaatccgctctccatgcttactcttgacaccccattgaagccactcattgtgtgtgcgtctgggtgtgaagtccagctccgtgtggtcctgtgcttgtactgccctgctttgcagttcctttgcacttactcatcgagtgctgttttgaaatgctgacattatataaacgtaaaagaaaatgtaaaaaaaaaaaacccacacacaaacaaacccatacgatctgtatttgtatatacacgtgtccgtacaagtataactaaataaaaattaaagattttcatcattttaattgga

SEQ ID NO: 2105 - DNA, 2774 bp, Homo sapiens
gggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaagcccccaccttctggccctttcacctcctccttgggaggggcaggattctcagatgacccctttaaaagtaaacaggacactcctgctctgcctccgaagaaacctgctcctccacggcctaaaccgcccagcggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctctgtaagttgagtcctccgcctccgggccaccccactcccttccgcttgcagcttccctgggatttttgtctccttttaaaggcaaacctcccagcttctttagcctcttggtacctcacactctctgtccctcgcgttatttattctacactgccacttctgtaagaaaaacagtttctcaat

SEQ ID NO: 2106 - DNA, 3054 bp, Homo sapiens
gctcggagcccgagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaagcccccaccttctggccctttcacctcctccttgggaggggcaggattctcagatgacccctttaaaagtaaacaggacactcctgctctgcctccgaagaaacctgctcctccacggcctaaaccgcccagcggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctcttttggcaatgaggagcagcagctggcgtgggccaagcgggagagcgagaaggcggaacaggagaggctggcgcggctgcggcggcaggagcaggaggacctggaactggccatcgcgctcagcaaggctgacatgcctgccgcctaggcgagggccgtgtgtaggcgggacagggcacgggcgggttccagagagggggcagtgcagatgtctatatatacacacacacaccgtcgccaccgtactccaaggaccgggactcgggggcttgttcagggtgagcagactcggctgcaagacctggaaaggtcacatctcctggggaagcccttacagaggccttggccaccacttctgcaggtccgtctctccactgtgccatcccccccggggctgactgcctcccgctcttcctctggggacgaacacacagcggtcagtcg

SEQ ID NO: 2107 - DNA, 2550 bp, Homo sapiens
aagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaaggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctctgtaagttgagtcctccgcctccgggccaccccactcccttccgcttgcagcttccctgggatttttgtctccttttaaaggcaaacctcccagc

SEQ ID NO: 2108 - DNA, 3486 bp, Homo sapiens
ggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggtaaaggttgaataaacgtattacagtatggggctctggtcccctggtgtgacagcagaacatcccacccgccagatctgttcatggccaacgttggttccagccaagtgcaggcggctgtctgttgtttttgctgccactttgcgcgttcacaccaggccttgcagcctggcacaggtggccatgctgaatcctggcttccagaacaaagtccaagataggcctggatcctttcagaacctgttttgaatgccctccatctctgcggaagtatttacattgggccaaccacccaagttcagagggcttctcaaacttaaccaaaattggatcagtttctgctcattgtggaaaccccacattctactaatcagggggcaggggacatctgaggggcatgtgtctatgtgtatgtgtgtttccacaaggaacaccttgaaaagcaaatgtgttgctaaagatgaggaagtaatggcaagcagcgccccagggtgttgctctttcaagtaagaattggcctctcctgaaattttggttatgtttaaaaacctctgcactttactctgacctcatgaccctggagttgtgatcaggcctggggcaggggactgtcggccccttacatttttgagagctcttgagcccctgataccaagacaggtgtgaccttttccttaggtggtcacatcccccctgttcacaccagagtctgcccctgcagcctcgaacctggggacatgtagtttcccatttcgtcttggtgctgttccgggagcggatgggccgggccgcgcatgtctggatgtttccttggtgctctgctgcctccagcagctctctccgtgctgccaccctctctcccagggctcctccctggagcccttctgctcctgggcctctgtacgtcatggattcctcttcctccctggaataagagtgagcgctcgtgctctctaaacaccacacttgcctctttatgttcaatgcttgatgtgtttcttttctcagcagccaagtcctcagtcccaaggatttatggggaagcacacgcgtcccctgggctgctgggaaggcactgctggcgagctcatctgtctcttgtgtctggcccccgctgggtgcaccgcctccctctttcctcccatactctcttttctcgtggactcgtaatgaggtggtttccatagccgcccccgggcccgtcatcatcagctttatcgtctaaatttaaacgatgagcattcatccttcatgagttacgagaagccagaactcctcgctttgctccctggctgttcttggcgtgtgtgtttccgtctcacaacccggctcctactttccccatctggcattgtcccctggcaccgcttttggcttgtcctgctcagtcttcgttcagggaacagcttcctcttaaatgtcccttttgcaggtttttagaaaccggttttcttggataaaagttggcagtgaagtggcagtttgcaagtggccagtgattcccccaactccaaagacagatttttacctttctggttatttttgttcatcttttgggcagggcaaaggttacctgagacacaattactttgggaatgtagattaagatacgttacatggaaacttgcaactggcatccgaaagaaaaactgtttttatcctgttgtacaaatacagtttttaaagcatt

SEQ ID NO: 2109 - DNA, 7439 bp, Homo sapiens
gcttgcgcgttagagatcgctgtccgctcttcctattggttcgtttttaggagctcggggaatacgaaatatccagccaataggagcagagatgccggaaccgggcttgtgtgcctctgctgaggtgatctggcgcagagcggaggaggtgcttggcgcttctcaggctcctcctctccccttgcggcctttctaacgttggccctgctcttgtggcctcccgcagaatgtggatgacgcccaaaagaagcaagatggaagtcgacgaggctctagttttccggcccgagtggacccagcgttatttggtggtggagcctccggagggcgatggggccctgtgcctggtctgtcgccgcctcatcgtagctacccgcgaacgcgacgtcaggcgccactacgaggctgagcacgaatactacgagcggtatgtggcggacggcgagcgcgcggccctggtggagcgtctgcgtcagggcgacttgcccgtggcctccttcactcctgaagagagagctgctcgtgcaggcctcgggctctgccgcctcttggccttgaagggtcgcggctggggtgagggggactttgtataccagtgcatggaggtgttgctgagagaggtactgcccgagcatgtaagcgtcctgcaaggcgttgacttatctccagatatcacaaggcagaggatcctgagcattgacaggaatctacgcaaccagctttttaaccgagccagggactttaaagcctattctcttgccttggacgaccaggcttttgtggcctatgagaactacctcctggtctttatccgcggtgtaggccctgagttggaggtgcaagaagatcttctgaccataatcaacctgactcatcatttcagtgttggtgcgctcatgtcggcaatcctagagtccctgcagacagcagggcttagcttgcagagaatggttggactgaccacgacccatactttgaggatgattggtgagaactcaggactcgtctcatacatgagagaaaaggccgtaagccccaactgttggaatgtcattcattattcaggatttcttcacttggaactgttgagctcctatgatgtagatgttaatcagatcataaataccatatccgaatggatagttttgattaagaccagaggcgttaggcgacctgaatttcagactttactaacggaatctgaatcagagcatggtgaaagggttaatggacgatgtctgaacaattggcttaggagagggaaaactttaaaactaatattctctctaagaaaagaaatggaagcgttcttggtttcagtaggggcaacaacagtccacttctcagacaaacaatggctttgtgactttggcttcttggtggacattatggaacaccttcgagaactcagtgaagaattacgagttagtaaagtctttgctgctgctgcctttgaccatatttgtactttcgaagttaagctgaatttatttcaaagacatattgaggaaaaaaatctaacagactttcctgccctcagagaagttgttgatgagctaaaacagcaaaataaggaagatgaaaaaatatttgatcctgataggtatcaaatggtgatctgtcgtctccaaaaagaatttgagagacattttaaggacctcaggttcattaaaaaggacttagaacttttttcaaatccatttaactttaaacctgaatatgcacctatttcagtgagggtggagctaacaaaacttcaggcaaacactaatctttggaatgaatacagaatcaaagacttggggcagttttatgctggattgtctgctgaatcctacccaattatcaaaggggttgcctgtaaggtggcatccttgtttgatagtaaccaaatctgtgaaaaggctttttcatatttgactcgaaaccaacacactttgagtcagccattaacagatgagcatctccaagccctgtttcgggttgccacaactgaaatggagcccggttgggatgaccttgtgagagaaagaaatgaatctaatccataaggctttgtagtacaagattgaaaaactcaacaagaatttaattctaaaagcaaaaattggtttgagttttcaagtttactaatttggattgtgagaaagtaccaagtaccagccgtccaaactgatcacaattaaaattctgacagttgccttttttttcatctcaaatggcagcatgggactgaaacatgagaatgccaccttttttaaaacttagtttagtgacaaagtcattgtcttttatgatatagttaattttaaagagatttagtattaatgtgagttgaatttgcagtctgttttttaggtgttctgaagataaatgccaaaaatttcagctcttattttaatggagtgttaaaattctgattcatatagtcttaaattatcaactccttaaatgtgcttttgaaccaatttgcagaagctcacatagcaagttcataagtttccaaaaaggaagcccatacataacagtggaggtgttttgtctaaccatcaaaatgtttgagacttttttttaaacatttctgagttcgaaggtaatactgacagatttcttccctcttccctccccatcacccacctcagtgataacacattactgatagaggaagtcattagaatcatttttaagtttcagatataggagacttcatgcaatttggagataagactaattattgggggttttccttggattttttttttaataactgggggctattttatcagcttgcctattaaaggactatggtaagtatagaatcttaatggttgccagttagtaattctttttttttttttttttactgtagacacaagtttggccctatcaaaaacgatgaggaaaaaagattgcactccaggattaggaggtgtgagatattttagcttttttgtcttatctgcgtgggtattgctgctttattttaaaaaatcctgcctaaagtaaacactttgttttaaaatgatacagtatcagattttgttagatgctagaaatggatttattctaaaatttggaactgtcgtacacattctatatgtaagatagcacacaagtagaaatatttaaaagcagtcttattcacagattgcagtaattctgtatttctactaagataatctgctttgtgccaaaacagtaatttccaaacttctgttcaccatgaaaaggcaatcttaaagttcattatgtaaaactaattataaacaggacccaatttatattcatagatcctctcaagtattatacaatttaaaaactcttgttccaaagtcctgtcttaactattgaaacaccttaatctgtggttactaatccagcaaattcaaggaaccaggctatgactaagaatttaggtggaattgatgtctgggcaattaaaataaatggcataagagcttaaaaaccaaagttgtgccagtggctttcaactagaggcagtaacctgtcattccagaggatgctgagaaatgtgtaggggcacttttttggttgtcatatttactaggggcttctgttggcatttaagcctaaagacactcacccctgcagtgcatgggacagcctggcacaatgaagaattagccctcccaaaatgtagattattttatttcaagggatagggcagattaccattagaagcaaaattaaaagtacaagctgggcaaactgacagaatactagataggagagactaattccaaccttctaaatttggctagtaaagtgcaataaaggcattgataagttctgttagctcaccatagcacttgtaaatcaggaattaataattgaatcagatttaagggctctgtcctgttatacatatttaaggcagaaaaaaagttacatgtcgattaggtacttatcaagaatggtcaagctgagattttggttaatagagtaagcttacatatctagagaaacaacatagtggaaaaccgaaaaaaaaaaacagaaaaatctaccggtaatttcccaatagctttgaatattcacagcagagctttattacttgagagaaagactggaagacctgaaagccacttctgctttctaaccccagttccttaaatattgaaatcttgtacattttgtgaaattccagtatgttttgcttaaggtgttaataaaattagtttgcatcatgtagtcattgagtgagggggagatataagccaaggattttaaattgacccttagctatagagaatttgctataagctagtcttgtttgtaaaaaaaaaaaaaaaaaaagaaaaagaaaaaagtgtattttactgttttctgtattaagtaattctgtaactgcatggcagtctttttttttttaaataaatatagttgttactggtcctgttgtagcagtgaatatagttaaaatacgtacattaaaaaaaaaattattaggtccttaccagttactgtcctatagctcattcctactagttttcttgacagatttgtattcccagtgtcccgtattgccactcaaattgctctactatgctaagtccttgttaatagtcttaccctccttgaaacacttgaacacttgatgactttagctttgaggagataccatctccaggtgtgctttcttagtctttgcaggcacctcttcccttcaatatctgttcttcgtatttttaaaaaaatttgttttagactgccttgttctgtgtcagctcgctagctgatctcatttccttccatggtttccttaccatttatatgcaaatgactgtcagattcatatctcctttctagatcttccctaattgatgtatctaattgctaacaaatgctctttgctgtctcaggcactacatgtcattgatcttgcccccaatcctgctcctcctctcatgtttcctctttgactaaatggcattaccactaccaaccattcatttgtcctttttaccaattctccaatgctgccattttaattcaggccatcaacctacctaaattatagcaacagcctccttattagtctccctgttttttatttttattcctttctacactacaaccaaattgctccaaaagacttactgatcatgtcactgcattgctttcaccattgctcttagggtacaatacaaatttatcttcatctttaaggtctcagtatgccacttcatctaggaaaccttcattgatgccctctagattaggtgcccttactatccattccctatacaccctgttctttcccagacatacacttggcacactttattgttactgcttattgatcactgctagactgtaagctttgtaagggcagggaccatataagccttgttcactgttatatctctagtgcttagcacaatgcctggcatttcaataaatgtttggacaaacgaatatttgtgtagtgttttacaatttttgaagctctttcacagtcttatttgaccttcacagtcattctgccttagactgtccattgggtaacttttatccacatattactaattgaaaaatgaagacaagttctttgtaactagggacctcgttgtattctcagaatttagtgtagtgcttagcatgtgacttaaatatgtattatgtgactgttaaacaaattgtggttttctctgttgtatgaaaggagagaaggataacaaattgcggttttccctggtaaacacagtaagtagtaaactcaggattcaaaaccaaatatacacaccaaatccactatgtaatattaagtttgcatatccatgtatagaatcttatttttttttaccctttgtaaacagtgtcatatatatatatatattttttttttttttttaaatttccaaaggaacctacatatagagggaaaagattagacaactacttagtgaactaaaacaatatgtttttactaaatgttacatttagtattggaaaaagataatgccgcctaagagttaataatcatttttccttttgtaggcatcaacactaggagaaaatggcatgctatttacttgctactttcctttacagatgatttttggctcttctgggatttaaaagtaagtaaatttaacaaagtagaagactgactcagcccttctggtcactatatattcagttcacttgtttttacacctgcagaatgtccttatcacccaaagggagatgacccaaaagtgacatctagttaatgtatacttctaaagtttgctgtattcctttgccttcttgttcccatgcctctctgaacttaatttctgggtaactgaggcttttcaggcttaggtgggaaagccacacccttagtctgtttccttaagccattttgaccaatttatgggattaactagtataatcttagttggagttttagtctgaggcatattaagtcattcagagatcttaacagtaggtgtcatagtcatccagtgatttggtgcttgctgcaaaactggcttttttttttttttttttttttgaggcggggtctcactttgtcacccaggctggagtgcagaggtacaatctcagctcaatgcaatctctgccttcctggctcaagcaattctcccactgcagcctcctaagtagctgggaatacaggtatacacgagtacacccagctaatttttgtatttttatgtggagacagggtcttgctgtattccccaggctagtctcgaattcctggactcaagcagtccgcccgcctcgggctcccaaaatgttggtgttatacgtgtgagcctctgcacccggcggcaaaactggcttttaatcaaccttttggctaaaggatttctctttttatttatttgtaaaaggatttcccatttttatctttctttttgatattaaaatgttgcctcatcctacccagtaagtacttgaatttgaattctcttccttttcatttttgcctgcaaactgaccagtcttttctgagttcatctcttctgtacgttttgtcaagtgcagtgaacagcaactacaaaatattttgtttttctgtctttttctttagtaaagggtagatgatctgcctttcaggttatctcaaggggcagtttcacctttccataatataaattacccttgtgtaagttatttcttccatcttctgatagcaatttcctgaatgcctgccagctaaccattaagccagtgttcagtattttagcattttaaaaaacaagggaccaatttctgtgtcagcatgggctagcttgccattgaataacaaaggcaaaatctcactgtctcacacaacttttctattgcaacttgcctagggactttggtttagatcataggttggccatgatcaaactatggtccatgggcaaaatctgtctagctccttatttatctaaataaagttttactggaatata

SEQ ID NO: 2110 - DNA, 1437 bp, Homo sapiens
ggcgcgcgtcgagaggcgacggcgggctggcctggcgcgctgcggcgctcgctcacccgctcccgaggaagggcagtgggccccgccgccgcctcccaatggcgaggctgcgggattgcctgccccgcctgatgctcacgctccggtccctgctcttctggtccctggtctactgctactgcgggctctgcgcctccatccacctgctcaaacttttgtggagcctcggcaaggggccggcgcagaccttccggcggcccgcccgggagcaccctcccgcgtgcctgagcgacccctccttgggcacccactgctacgtgcggatcaaggattcagggttaagatttcactatgttgctgctggagaaagaggcaaaccacttatgctgctgcttcatggatttccagaattctggtattcttggcgttaccaactgagagaatttaaaagtgaatatcgagttgtagcactggatttgagaggttatggagaaacagatgctcccattcatcgacagaattataaattggattgtctaattacagatataaaggatattttagattctttagggtatagcaaatgtgttcttattggccatgactgggggggcatgattgcttggctaattgccatctgttatcctgaaatggtgatgaagcttattgttattaacttccctcatccaaatgtatttacagaatatattttacgacaccctgctcagctgttgaaatccagttattattacttcttccaaataccatggttcccagaatttatgttctcaataaatgatttcaaggttttgaaacatctgtttaccagtcacagcactggcattggaagaaaaggatgccaattaacaacagaggatcttgaagcttatatttatgtcttttctcagcctggagcattaagtggcccaattaaccattaccgaaatatcttcagctgcctgcctctcaaacatcacatggtgaccactccaacactactactgtggggagagaatgacgcattcatggaggttgagatggctgaagtcacaaagatttatgttaaaaactatttcaggctaactattttgtcagaagccagtcattggcttcagcaagaccaacctgacatagtgaacaaattgatatggacatttctaaaagaagaaacaagaaaaaaagattgacttttctttatcttctatgaagggtctgtaatgaaatctctaaataatttttaaaaattgttcatcaacttctttatgttttattagaaaaaaactgttttaatgtgctttatcataaataaatatcctgacaaatggtattgaaaaaaatctgagatcatgtgaacatataatacaatgttgattttcttctggtgtattttgcacagacaagcatctgccttaaaatatatacacttgtacaaaaagg

SEQ ID NO: 2111 - DNA, 6146 bp, Homo sapiens
ggctagttcctggtgcgtcacgggggagttccttaaaggggaagcgagccgggctacggggcgagcgcggggtgcggtggtcggcggggaggcccccgcgctttaaaataatgcccgcggcgcccgcgcgaccatgcaatggcgagcgctcgtcctggggctggtgctcctccggcttggcctccatggagtattgtggctcgtcttcgggctggggcccagcatgggcttctaccagcgctttccgctcagcttcggcttccagcgtctgaggagccccgacggccccgcgtcgcccacctcggggcccgtgggccggcctgggggggtatccgggccgtcgtggctgcagccgccggggaccggggcagcgcagagcccgcgcaaggctccgcggcgtcctgggccggggatgtgcggcccagccaactggggctacgtgctgggcggccggggccgcggcccggacgagtacgagaagcgctacagcggcgccttccctccgcagctgcgtgcccagatgcgcgacctggcacggggcatgttcgtctttggctacgacaactacatggctcacgccttcccccaggacgagctcaaccccatccactgccgcggccgtgggcccgaccgcggggacccttcaaatctgaacatcaatgatgtactagggaactactcattgactcttgttgatgcattggatacacttgcaataatgggaaattcatccgagttccagaaagccgtcaagttagtgatcaacacagtttcatttgacaaagattccaccgtccaagtctttgaggccacgataagggtcctgggaagcctcctttctgctcacagaataataactgactccaagcagccctttggtgacatgacaattaaggactatgataatgagttgttatacatggcccatgacctggcggtgcggctcctccctgcttttgaaaacaccaagacagggattccatatcctcgggtgaatctaaagacaggagttcctcctgacaccaataatgagacatgcacagcgggagccggttccctcctggtggaatttgggattctgagtcgactcctgggggactccacatttgagtgggtggccagacgagcagtgaaagccctttggaacctccggagcaatgatacaggattactaggcaatgtcgtgaacattcagacgggccactgggttggaaagcagagtggcctgggtgccgggctggactccttctatgaatacctcttgaaatcttacattctctttggagaaaaagaagacctagaaatgtttaatgctgcatatcagagtattcagaactacttaagaagagggcgggaagcctgcaatgaaggagaaggagaccctccactctatgtcaacgtgaacatgttcagtgggcagctgatgaacacctggattgactctctgcaggcctttttccctggactgcaggtgctgataggagatgtggaagatgccatctgccttcatgccttctactatgccatatggaaacgatatggtgccctccctgagagatataactggcagctgcaggcccctgacgttctcttctacccactgagaccagagttagtggaatccacatatctcctctaccaggcaaccaagaatcccttctacctccatgtaggaatggatattctgcagagtctggaaaagtacacaaaagtcaagtgtgggtacgccacgctgcatcacgtcattgacaagtccacagaagaccggatggagagcttctttctcagtgagacctgtaaatatttgtatctgctgtttgatgaagacaatccagtacacaagtctggaaccagatacatgttcacaacagagggacacattgtatctgtggatgagcatcttcgggaattgccatggaaggaattcttctctgaagagggagggcaggaccaagggggaaagtctgtgcacaggccgaaacctcatgagttaaaagtcatcaactccagctccaactgcaatcgtgtacctgatgagaggaggtactccctgcccttaaagagcatctacatgcgacagattgaccagatggttggtttgatttgatctgctctctgtgaggcctcatcttgaaccagaccttaacgaccaaacccagaccatgccaaagtccagtctgaaatgaaaggggacagaagtcttgctgtccatggtggtgtaggaatttctgtgcaacacctcaccacgtctggttaatccttgcacacttcagtgtttctctcctgttcaataaaatgccctgttaaggatataatttgaagtgagaagatacatggaaattgccctcttatgacatgttgatgttataagcacaatagatggggcatctttggattgatgttcacagctttatacttcagaacctaagtctcttcactttgctggcacctgctatactggagtattgctatgtctttaaaaaattttttttattatattttatttttttgagacagggtcttgatatttttttgggacagggttacctgggctcaagtgatccttctgcctcagcctcccgagtagctgggattacaggtgagcaccactgtacctggctagctacttctttgttagaggattgagaatgaaatttctgcaaaagggcccatggttcatttggtatccctatttaattgcattgaaaatgtcatcctttctgttgttagataattggggtcttcccctgatatccaaccgtgattttggatcacatgggagaaaaagtcatccagtttttcatgtttgcctcaagtaatctttacagtgttacaaattatttgcttaagaagaatggtcttaaccagaattcttaacagatagtctcttaggttattatgttatggtctaagaggttaactgacatcttttgggtggtattttgcattttgaatatgaacttacctgaggaactcccatagttccagaatcaggtgccttttagggagagaacaatacctaagattgtctgagcttccatctttctcatatttcctaagcaaggattctcacttctgaccatatttgggttagagttctgttttgtttctgttttctgtgtctagtgccaattagctaaatcagggagaaagaaatgatcacatgacttttagcatccttgagccatttctctgtgtaatacaggctttagattagtgccttatattggttttggtttggggcactggatgtcgcagctactgctatggtttcaggaggcctgtttagccacatggtgagaccgtggtgaaagggggatggaaattgcttggccagtctttgcctttcatcctgtaaaagtaagcatgtagaaggaggaagttgtgctaaaatgcctttgtttttttgttattattttcttagccagaacatctctctttgaactcacactgatacacacctgctactcttacacagtgcagcagggttgactcttagtctggcttccatgaagcgtcatgggtggaaacgcattctagtaaaaaaggtaggaaatccctaaaacttccagcctcacatagcacggttctcacctgtcactgttttcccacctctaaggatttcatgtacatcttttcaaagctagaaataagcactgtctaagtttatgttgcatttttagtcaaaagggagaaatcttattccttcttgaaaattttaagtgttatggttttatatagttcagttctttgagatttttgaaaagagtattttcagtaataaacgtgccatctctatctcttaaacatttattacaacaattgttttaaaatagaaaaaataaaatgcttctattttaccttttttcatttcagaagcattattctgtttattaacagtgtcccatctactgaatagaaaactttgagaataatatatatatatattttaaatgttttcactgactcattgaaaatgttaattacacacacatgcatgcatgcacacacgagcatacttgtacctttgtctctgggcaaacaggtgggactgttagtgacccatttgggaaaatagagcatctcagagaaggaggtgagttcttcctgcctgtgatttctcttggcgctcccctcctctcccgctctggcttctgtggcggcagtggtgggtaagcactccagtgttctcttaatgaggcactttgcctgtcactcgagcaagcctgggtgttccttcctcctcatgctcctggaatagggaatagggatctcatgcttgcaaactacacaatgctgcaggtgcttcccaggggccacaggctgtcaggaaacgtgttttatgttaagtcacaaacccacttgacttctgggtactggaattaataccagtgggtgagactgagggtgagtgagttagtacatattaatcctggttgttgagcttccagactaccccgtccaaagtttgatgctatgtagtcagtggtttgtggggctggatgccagaaggttctttgagccagtttcaaaggttacttgttttttttttttttttttaaagtcagaatgttaacagctgtgatatatcctgcagggcttttgcagtttcttctgttctgtgttctgaaatactgggtagagaatggctgaggaggagattaccagagaagttgctttgctcagtgctttgccccaggattgcctcaaatctgagtggacttcatcctttgcggcggctctgagcctggcccatcttcctattcccacgtgtagctagtgtctagtgtcagctttgctcagtgtggtggaaacattttgcagaactgttgtagaaagctgccttatagttggcttgacaaagcataattctctcataacaaactttcaaatcattacagtagcttagctactttagttgatgtgaccgaggaatcccttctagaatcataggtggcaagggagggtttgctagctctccatttgcactggccattgtgaaaaaccagcttctgtattcaaatctttccttcatttttttaaattttttttttggcagcgcttgtgctggaacttactcattgtaactgaatcctcagggcttttcttgttttagatcatggactgtgcacgtgacacttaaataattttctatgtatttaaagaaaaatgcaccaggatggtgtctgtgcacgtgactattagaggagcgtctgtagaagtacctggtttggtcagtgcagttgtgcaatctgagggccttgtttcctcctcccctttccccttctccccaccaaaggaaaatatccctcttaatgatttcgtagttcagtttactgaatgattaccacctgtaattcctctttggattgtgtagactcaacatgagacattcctttctgctttctggagggcaccaggggcctttctctttgataaattttttttgtctgttgacaaaaacaaaaatcttttttcaaatgtagtgctggtgaaaaggtagggctgagtgattaccttagccacagggtggctgagcaggaactttagaagaaaatcctgagctttcctgtccattcccagcatccagctcctattctagtgcctcttccctgcagggcagggaccccttgggaaatcgaggaggtgggacgggctgggccctgtgtcccaggtttcacagggctcagggttatgctcccgcttgaatctggacgtgaatctggtaaaaatatcaagtacctgtggaactccctgattctataccctcttccttctttctgcaaggcagaggaataatatttttaaaggttattttgttttagttttaaatagcaaaacacaagctgcatttttatttattttgcataagaaaggtaaatctttttacaaaaaaaagtatagagttggaaactctgggaaaacttacggaaatacacaaatgcttctctgtaatgtgcaatatgctttgcaactgtagatgatattttatgtttaatctgtaaataagaaatgtatttaaattaaaagggatctttttgtaaaaggaccaaatgttcttttataaatgtaataaggaatatcttgctctttaaaatttattaggatttttatgagtaatttttattaaaagatttctttttttg

SEQ ID NO: 2112 - DNA, 976 bp, Homo sapiens
cggagagcctgggggttggggacgatgggctagttcctgctgcgtgcccagatgcgcgacctggcacggggcatgttcgtctttggctacgacaactacatggctcacgccttcccccaggacgagctcaaccccatccactgccgcggccgtgggcccgaccgcggggacccttcaaatctgaacatcaatgatgtactagggaactactcattgactcttgttgatgcattggatacacttgcaggtcctgggaagcctcctttctgctcacagaataataactgactccaagcagccctttggtgacatgacaattaaggactatgataatgagttgttatacatggcccatgacctggcggtgcggctcctccctgcttttgaaaacaccaagacagggattccatatcctcgggtgaatctaaagacaggagttcctcctgacaccaataatgagacatgcacagcgggagccggttccctcctggtggaatttgggattctgagtcgactcctgggggactccacatttgagtgggtggccagacgagcagtgaaagccctttggaacctccggagcaatgatacaggattactaggcaatgtcgtgaacattcagacgggccactgggttggaaagcagagtggcctgggtgccgggctggactccttctatgaatacctcttgaaatcttacattctctttggagaaaaagaagacctagaaatgtttaatgctgcatatcagagtattcagaactacttaagaagagggcgggaagcctgcaatgaaggagaaggagaccctccactctgtcaacgtgaacatgttcagtgggcagctgatgaacacctggattgactctctgcaggcctttttccctggactgcaggtgctgataggagatgtggaagatgccatctgccttcatgccttctactatgccatatggaaacgatatggtgccctccc

SEQ ID NO: 2113 - DNA, 1363 bp, Homo sapiens
acgcgcttccttccgccctccgcgccggggtgcagccctctgtcctccggggcccccgagggcgccagggccgttagggtcccgggcagcgctcccgcgccctgtcccgtttcaaatctgaacatcaatgatgtactagggaactactcattgactcttgttgatgcattggatacacttgcaataatgggaaattcatccgagttccagaaagccgtcaagttagtgatcaacacagtttcatttgacaaagattccaccgtccaagtctttgaggccacgataagggtcctgggaagcctcctttctgctcacagaataataactgactccaagcagccctttggtgacatgacaattaaggactatgataatgagttgttatacatggcccatgacctggcggtgcggctcctccctgcttttgaaaacaccaagacagggattccatatcctcgggtgaatctaaagacaggagttcctcctgacaccaataatgagacatgcacagcgggagccggttccctcctggtggaatttgggattctgagtcgactcctgggggactccacatttgagtgggtggccagacgagcagtgaaagccctttggaacctccggagcaatgatacaggattactaggcaatgtcgtgaacattcagacgggccactgggttggaaagcagagtggcctgggtgccgggctggactccttctatgaatacctcttgaaatcttacattctctttggagaaaaagaagacctagaaatgtttaatgctgcatatcagagtattcagaactacttaagaagagggcgggaagcctgcaatgaaggagaaggagaccctccactctatgtcaacgtgaacatgttcagtgggcagctgatgaacacctggattgactctctgcaggcctttttccctggactgcaggtgctgataggagatgtggaagatgccatctgccttcatgccttctactatgccatatggaaacgatatggtgccctccctgagagatataactggcagctgcaggcccctgacgttctcttctacccactgagaccagagttagtggaatccacatatctcctctaccaggcaaccaagaatcccttctacctccatgtaggaatggatattctgcagagtctggaaaagtacacaaaagtcaagtgtgggtacgccacgctgcatcacgtcattgacaagtccacagaagaccggatggagagcttctttctcagtgagacctgtaaatatttgtatctggtatgtgtgttgcaagatgaacccaggaatatttagtattgcttagagcaagcattcgcatagtcttccatctgacaggtac

SEQ ID NO: 2114 - DNA, 6626 bp, Homo sapiens
agtaacgttggggaggcggtttcctagactacgacaccggaaagctgggggaggcgctccgggatactgagggcggagggcggtggcagcgctggcgctggggaccggcttggtggcttcgggaaacagtttggcgccggcggccgtccgtgttactccgcatcccgccccgtctcggcacggctagcagccccctggccaccagcgtccagcaatgtgtctcaccggccgggcgtagcagctgcgcgtgcgcggaaccgcggggccatgagcgaagccggcggccggggctgtgggtccccggttccccagcgagcgcgatggagactagtggcggcgacggccgcgttctgcctggtgtcggccacctccgtgtggacggcgggggccgagcccatgagtagggaggagaaacagaagcttgggaatcaagtactggaaatgtttgatcatgcttatggtaactatatggaacatgcttaccctgctgatgaactcatgcctttaacctgtagaggtcgagttagaggccaagagccaagtcgcggtgacgttgatgatgccttgggaaaattttctctgacactgattgattctttggacactcttgtggttttaaataaaactaaagaatttgaagatgcagtgagaaaagttttaagagatgttaatttagataacgatgtagtcgtatcagtctttgaaacaaacatcagagttcttgggggtcttttgggtgggcactccctggcaatcatgctgaaagaaaaaggtgaatatatgcagtggtacaatgatgaacttctccaaatggcaaagcagttaggttacaaacttttaccggctttcaacactaccagtggccttccttatccaagaattaatttaaagtttggcatcagaaaaccagaagctcggacaggaactgagacagatacctgtacagcttgtgcaggtaccttgatccttgaatttgctgctttaagtcgattcacaggagcaacaatatttgaggaatatgccagaaaagctcttgattttctctgggaaaaaagacagcgaagtagtaatttagtgggcgtgactataaatattcatactggagattgggtacgaaaagatagtggagttggagcagggattgattcatattatgaatatctgttgaaagcctatgtcttgcttggagatgacagttttctggaaagatttaacacacactatgatgccataatgaggtatattagccagccacctcttctacttgatgtgcatatccacaaaccaatgctgaatgctcggacttggatggatgctttgcttgccttcttcccaggcttgcaggtgttaaagggggatattagacctgctattgaaactcatgaaatgttatatcaggtgattaaaaaacacaattttctaccagaggcatttaccacagatttcagagtacactgggctcaacatcctttaaggccagaatttgcagaaagtacctacttcttatataaagctacaggagatccttactaccttgaagtagggaagacacttattgaaaatttaaataaatatgctagagtgccttgcggatttgctgccatgaaggatgttcgtactggaagtcatgaggacagaatggattctttcttcttggctgaaatgtttaaatatctttacctgttatttgctgataaagaagacattatttttgacatagaagattacatctttacaacagaagctcatctgttacctctttggctctctactacaaatcaaagcatctctaaaaagaacacaacctcggaatatacagaactggatgacagtaacttcgattggacttgtccaaatactcagatcctctttcctaatgacccattgtatgctcaaagtattcgtgagcccttgaaaaatgtggtggataagagctgtcctagaggcatcatcagagtagaggagagtttcaggagtggagctaaaccccctctgagagccagagatttcatggccactaaccctgagcatttagaaatcctgaagaagatgggggtgagtttgattcacctcaaagatgggagagtccagttggtccaacatgcaatccaagctgctagttcaatcgacgctgaagatgggttgaggttcatgcaggagatgattgaattgtcaagtcagcaacaaaaagaacagcagctgcctccacgagctgtacaaattgtttcccacccattttttggcagggtagtattgactgctggaccagctcagtttgggctggatctgtctaaacataaagagacaagaggatttgttgcaagcagtaaaccatccaatggttgttcagagcttactaacccagaggcagtgatgggaaaaatcgcactgatacaaagaggacagtgcatgtttgcagaaaaggcacgcaacatccagaatgctggagccattggtggcattgttattgatgacaatgaggggagcagcagtgatactgcccctctgttccagatggcaggtgatggaaaggatacagatgacatcaagatccccatgctgttcttattcagcaaagaaggaagtatcatactggatgccatccgggaatatgaggaggtagaagtgctcctctctgataaagcaaaagatcgagatcctgaaatggaaaatgaagaacaaccatcctctgaaaatgattctcagaatcagagtggtgaacagatttcatcaagttctcaggaggttgatttggttgatcaagagtcttctgaggaaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatgacttgctaaacaatctgttggtaggtatttaaaaagaaaaggtaaactgtgtgtggttaatagacatcctaatactaagcaggctttctaatgggaggctttaagtatggtgatgaacaaccacgttctgactggcgtagttatcgtaggaatctggagcatgctgtgttagaattgaccttgtttaaaactgtcccatcaaaaatggaaatccacagttcccccttcaaatgcagcactgcaccaccctgcaacacctcaggccagggaaagattactgagcattcctgcgaaccagatttctgttgtctctggatagacaagaaacaaaattcatttagtagtggagtggggaataggagtttggatagccttctaattaaaggaagctcgcctttcttggttttgggggttagaggctcttttgggaagatgcatccgagtattgtggcattctgattatgctgccttcacaaaacactctaagtgacctaagtggttatgaagcaaatgcatttatggtgaaaacagtctttgctcattgctttctcttgtttcatttagtgacaaatgatcaagatgacttgattttttttccttcttaacaatgtcttttttatttaaaccaaaggtgaagccagtgtactttctcagtgagttctctgcataaagactaatcagtgggaccaggtaaaaaggtcatataatacattgtggagattgcttacttaatacttctgaaaaatggagtaagggagaaactgtaatgttgcaatatgaacctcccattgggccttccatagggaaagctgtgactactctgaaatggaacctagcattatatccttgtagggtagattataaatcatttccagttcatttctcttagaggtgattacctctagccatcagccttactccatcccatgtttggtatgcaatttgagccacaaggctcgtatcgccaacagctatatacattttgttccatttttctgtcttacagagccatgatagaactgtggttagtgagttaaaattcctggagtaactactgtttttctcctttgaaacttaggtttctaaagttgcacctaaggaatctgtcacattttctgttgaatcatggtttttgtttttgtttttaacagatattccttctgatacggacttgaaaattagtgtatggtgacctgtgtttaaaaaaaaaagtacaatacaactacatatagctatatagcttaatgagacttccaccccccccctttttttttttggtttgttgttgttgtagtagtctggtgctggccacatttaagtcttaaaaatttttaaattttgttgttgatgtttgtagacagccctgttgttgaaatcatggctttattcattttatttattttttaaacttgcctgaatttgttctaaaggaatatttaagagacataattttcttctctttaccataacattacacaaaactttttcctaaaacacggttgtgaggtactgatgaggtgtaagtggagctgttaaaaacagcagtgctgtattgcagttatgtatattcgtgtacagtatgtttagatcccaggtaaacatattcttttctgagaggataaatacctgcattcagatattccaggtaaatataattgagtcagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatggaaggatagatatagtgctttgttcattttaattgcaaagctgccaaaatagttgaagcttaattacttgacttgccttgatttataggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaagaaaaggaaaaaatttaaccaatttttcttaatacccagaaggaattatactcaatatttccctagttaagaaaagaggagataatgttcgtctaaaaaactccaacgttgtaattacaactctacattcatttacttacttgacatactgccacaaagtagtttttgagttcattaaaaattccaaaggcattagttgttttttttttttttagtgttttgttttttagttaacttttatagacattttagtaacttgctaaagattcaggggattctatgaaaccccgaatttagaaacatctggtctacctcagttaaatgttgactgcttagaaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaaagaaaaattgtacactttctgattttaacttcactaatgtaattactctctcaagaagcttttaaaatttaaattaccatcacacaaccttttttatagtaaagccaacatttgttctctcaccaaaccccatgccaaattcatcatgaagaaagctcagcataagtaattcaaatactgcttataattttagaggggggtagaatttagtaaatattccagccggtcgttttatgcacaaggcttcagtcagaacatagaaaaaaaaaacattctgtgaatgaaatattgtatgttcagattttataaaagacatttttaaaagcccaatttacagccgtatattttcttatgatgtaatttatgaaaaagatgtctgtactaacaggtgctgtaacactactgttgttggattttattgtttggtgataaatgtatacaatatttctaagggaaactatgtactgtgatgtaaaagtctgggcaaaatgtatataatcctgtatataattatgtatttgattataattactgattgtaaagatttaataaaatatgtaaatattcca

SEQ ID NO: 2115 - DNA, 3008 bp, Homo sapiens
cgttctgcctggtgtcggccacctccgtgtggacggcgggggccgagcccatgagtagggaggagaaacagaagcttgggaatcaagtactggaaatgtttgatcatgcttatggtaactatatggaacatgcttaccctgctgatgaactcatgcctttaacctgtagaggtcgagttagaggccaagagccaagtcgcggtgacgttgatgatgccttgggaaaattttctctgacactgattgattctttggacactcttgtggttttaaataaaactaaagaatttgaagatgcagtgagaaaagttttaagagatgttaatttagataacgatgtagtcgtatcagtctttgaaacaaacatcagagttcttgggggtcttttgggtgggcactccctggcaatcatgctgaaagaaaaaggtgaatatatgcagtggtacaatgatgaacttctccaaatggcaaagcagttaggttacaaacttttaccggctttcaacactaccagtggccttccttatccaagaattaatttaaagtttggcatcagaaaaccagaagctcggacaggaactgagacagatacctgtacagcttgtgcaggtaccttgatccttgaatttgctgctttaagtcgattcacaggagcaacaatatttgaggaatatgccagaaaagctcttgattttctctgggaaaaaagacagcgaagtagtaatttagtgggcgtgactataaatattcatactggagattgggtacgaaaagatagtggagttggagcagggattgattcatattatgaatatctgttgaaagcctatgtcttgcttggagatgacagttttctggaaagatttaacacacactatgatgccataatgaggtatattagccagccacctcttctacttgatgtgcatatccacaaaccaatgctgaatgctcggacttggatggatgctttgcttgccttcttcccaggcttgcaggtgttaaagggggatattagacctgctattgaaactcatgaaatgttatatcaggtgattaaaaaacacaattttctaccagaggcatttaccacagatttcagagtacactgggctcaacatcctttaaggccagaatttgcagaaagtacctacttcttatataaagctacaggagatccttactaccttgaagtagggaagacacttattgaaaatttaaataaatatgctagagtgccttgcggatttgctgccatgaaggatgttcgtactggaagtcatgaggacagaatggattctttcttcttggctgaaatgtttaaatatctttacctgttatttgctgataaagaagacattatttttgacatagaagattacatctttacaacagaagctcatctgttacctctttggctctctactacaaatcaaagcatctctaaaaagaacacaacctcggaatatacagaactggatgacagtaacttcgattggacttgtccaaatactcagatcctctttcctaatgacccattgtatgctcaaagtattcgtgagcccttgaaaaatgtggtggataagagctgtcctagaggcatcatcagagtagaggagagtttcaggagtggagctaaaccccctctgagagccagagatttcatggccactaaccctgagcatttagaaatcctgaagaagatgggggtgagtttgattcacctcaaagatgggagagtccagttggtccaacatgcaatccaagctgctagttcaatcgacgctgaagatgggttgaggttcatgcaggagatgattgaattgtcaagtcagcaacaaaaagaacagcagctgcctccacgagctgtacaaattgtttcccacccattttttggcagggtagtattgactgctggaccagctcagtttgggctggatctgtctaaacataaagagacaagaggatttgttgcaagcagtaaaccatccaatggttgttcagagcttactaacccagaggcagtgatgggaaaaatcgcactgatacaaagaggacagtgcatgtttgcagaaaaggcacgcaacatccagaatgctggagccattggtggcattgttattgatgacaatgaggggagcagcagtgatactgcccctctgttccagatggcaggtgatggaaaggatacagatgacatcaagatccccatgctgttcttattcagcaaagaaggaagtatcatactggatgccatccgggaatatgaggaggtagaagtgctcctctctgataaagcaaaagatcgagcagcaatattaaaaggtaaaatgattccaagctacattattaatagtaatcctgaaatggaaaatgaagaacaaccatcctctgaaaatgattctcagaatcagagtggtgaacagatttcatcaagttctcaggaggttgatttggttgatcaagagtcttctgaggaaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatgacttgctaaacaatctgttggtaggtatttaaaaagaaaaggtaaactgtgtgtggttaatagacatcctaatactaagcaggctttctaatgggaggctttaagtatggtgatgaacaaccacgttctgactggcgtagttatcgtaggaatctggagcatgctgtgttagaattgaccttgtttaaaactgtcccatcaaaaatggaaatccacagttcccccttcaaatgcagcactg

SEQ ID NO: 2116 - DNA, 1861 bp, Homo sapiens
cctggtcggttcccgcagtgccttgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacaccctggcacccattgccccagcccagcagttaaggacccaaacacacaatctgtgggaaatcctcagaggattggctggccccacttcaaggagatcttcatgttgtcagccctaagccaggaggacgtgaaaacactaaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctgtccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcctctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctcatcttta

SEQ ID NO: 2117 - DNA, 1013 bp, Homo sapiens
tggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtggtgggtacctacaaagggagtccttgaaacaggacagagggtgaagctaagagggtctcccttaccatcagccttgaagaaaatgatggtcacattcatttatattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacaccctggcacccattgccccagcccagcagttaaggacccaaacacacaatctgtgggaaatcctcagaggattggctggccccacttcaagga

SEQ ID NO: 2118 - DNA, 1313 bp, Homo sapiens
ctttccggccggtccccatggaggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccagggggaggaagtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagt

SEQ ID NO: 2119 - DNA, 1359 bp, Homo sapiens
aggggggcgtggctccaggccggaagagggagtctgtaggggcgggccggctggcgtcccctttccggccggtccccatggaggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 2120 - DNA, 832 bp, Homo sapiens
cgctggggaagctgaagcagttcgatgcctaccccaagactttggaggacttccgggtcaagacctgcgggggcgccaccgtgaccattgtcagtggccttctcatgctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagt

SEQ ID NO: 2121 - DNA, 1357 bp, Homo sapiens
ggccggaagagggagtctgtaggggcgggccggctggcgtcccctttccggccggtccccatggaggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtacatgctgtggagatccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 2122 - DNA, 1343 bp, Homo sapiens
ctttccggccggtccccatggaggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgggtgtgtgtgcaggttaaagatgatagcacggagcctggcttgtgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagt

SEQ ID NO: 2123 - DNA, 5285 bp, Homo sapiens
cgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcaaatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaaaatcgtgccctctttacatatgtcttatcaggtataacatgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatgaatgtatgcatatgtattcagtatattttaaatgaataatcacagaagtaagtttaataatttgtcctatttttctctgtcacttcctttttctctaaggcaggaaaggaaagacattaaaccattaattaagtcaatcctcttggagactcaaaagactatgaagtgatcactctatataaaatataaatacagtgtgggttcaaatggccattttttgtgtgtccctctctctcatcttatgcttcccttcctttttttatttttattttttggagacggagtcttgctgtgtcgcccaggttggagtgcagtggcgtgatcttagctcactgcaagctctgccttccaggttcacgccattcttctgcctcagccccctgagtagctgggactacaggcgcccgccaccacgcccggctaatttttttttttttttttttgtatttttagtagaggcagtgtttcaccgtgttagccaggatggtcttgatctcctgacctcgtgatccacccacctcgacctcccaaagtgctgggattacaggcgtgagccaccacgcccggcctcttttttttttagctgccaatctttttgaaggaatattcttacctctactttgtcaccttctactggctccttaactaaaatctgccatttggctctctggttaacagtcccttcctgtaaagtctaaaatcttaattctaaatccacagtttaattcacaagctagtacttgactttttttctgtatttgacatttttgacaacccctactttaaagatttattcccttgacttcttacattttgctcactcctgaaccaccccccaccttttggcctcttcatttattccttaaatgttattcctcagacctccattttttttttctctcttaatcacaacaccacttctcacgcttgggtaattttaattcagcagttcctaaatccttatctttagccagactcctcaatccatctgcctgttgcacttttcttggttgtcccagagacacctgtgtgtgtcttaaaacattcattctctgcaaaacctactctaatgcctgtgtcccttactttggttaattttagaaccattatattctaagttttctaggctcattcctctcctccaccttcccctatcatttagtgtctaagttttactgattttatctccacctctctgatacatcactctttcatcttcattgctattattaataaatacctacagtactaacctgcctcctatacctagctggtctcctctctgttgctcaatgttaccacagcaggctttctagaagcactctgacagtgttactccctaatatccttcagtgacttcaggaactttcaggagaaagccaaactcctctgtttggtgtacaaggtcttctgatgtgtttcctccaccgaatgttctggtgaaacagacttacacttcttcagaagccacatttggccaggcctcccgccttggtaaatgctgtactctttgcatcaagtatgctagtcatccttccccacttggaaaattcctatgcatcttgcaggcctgacataagcatttcctctgtgaaacctcctttgctccactcaaggagagtcatctaacttccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgaataaattgattttaaagtgacatctttattatattagaggtcctacctatattccaaatactttcactcccttcactttacagcaagggtcagtagagtcccaaggatttgtagactttagggggtcaataaagctgaaattgtattca

SEQ ID NO: 2124 - DNA, 1177 bp, Homo sapiens
tggggacctaatattaaagaattcaaacaccgctttgaccctgtggaaaccaagggagaaggtccaagaaggctcaagaatctttactttttatacttgattgagcttcgagctttgtcaaaggtggctccatattttgagcgctcaattgtcgatctttacactggaaatgcagaagaagatgctgacacaaaaactcttctactgaatatctttcaagatacaaagtcctttcccatgcactttgatgagaaatccatgtttgcaggtgacaaaaaaggggccaagtcactaaaggaggaattccgattacatttcaagaatatctcccgtataatggactgtgttggatgtgacaaatgcagattatggggaaaattacagactcagggtttaggaactgccctgaagatattattctctgaaaaagaaatccaaaagcttccagagaatagtccatctaaaggcttccaactcacccgacaggaaatagttgctcttttaaatgcttttggaaggtaagaaccattatatgttgaagatttttgatttcccattgggtttcaacaaactgcaaagataatcttctttgctaaaagtagggtttgttttgttgacaaaaaaaaattttatattgtatctgtactaacttagagaggccttaatgctgacaagtcagtttctctacaggtcataggaaaaactaagtttccaattgccagtgtttttcagtttgctgccttaattttgtaagggagatattcttctaatattctttttgcttggctataacttgttcaactacaatagcaggagtaaggaatgtgtgattgagaaggtgataaaagaaaattaaaaccttcatctgctccttatttttcttaaattttcattactatttttttcttttctcacctttttcctgcactatgctctttatttctgaagctcagaggtcatttttctttcactcatttctacatgatttacttctgtatagagacatataatttgcttgcttgtttatatcaccagtggtttaaaaaataatttgaatttgccagcagagatacatgtaatgccaactgaggaatacagaacagaaggaaaagaatcacagaaaataatactatgcttccttggggaaaaagagaaaaaagtcaacttgaggaagaat

SEQ ID NO: 2125 - DNA, 1081 bp, Homo sapiens
aagcgagccgggggcggggccgcctgggggatgaagtgggggcgctcgcctttcctgcctcactcgcagctgccgggtgttggggaaagagtcgcctgcctccggactggagtgcagacctctgaccctggagtcgctcggccgctgggaaccgtccccttgggtcgtcgcctgggccgcccgtcgttccccggccccgaggggtccggctggccgcggtgtgggtagaggtcagcatgagccaaggggtccgccgggcaggcgctgggcagggggtagcggccgcggtgcagctgctggtcaccctgagcttcctgcggagcgtcgtcgaggcgcaggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtacttgaaaatggcaaacaataccaaagaattagaagattgtgagcaagctaataaactgggagcaattaacagcacattaagatgagagatctccagctgctcagtatgtagacctattgctgaacccagagcgttacactggctataaagggacctctgcatggagagtgtggaacagcatctatgaagagaactgtttcaagtaactggagggggtgggggaagaaggaacgactgatagagggtcgggagaggccgggtgctgtggctcacgcctgtaatcccagcactttgggaggccaaggtgggtggatcatctgaggtcaggagttcaagaccagcctggccaacatggtgaaaccccgtgtcaactaaaaatacaaaaaaattagccgggcatgatggcaggtgcctgtaatcccagctacttgggaggctgaggcaggagaatcacttgaacccgggaggcagaggttacaatgagcagagattgcg

SEQ ID NO: 2126 - DNA, 4567 bp, Homo sapiens
agtgggggcgctcgcctttcctgcctcactcgcagctgccgggtgttggggaaagagtcgcctgcctccggactggagtgcagacctctgaccctggagtcgctcggccgctgggaaccgtccccttgggtcgtcgcctgggccgcccgtcgttccccggccccgaggggtccggctggccgcggtgtgggtagaggtcagcatgagccaaggggtccgccgggcaggcgctgggcagggggtagcggccgcggtgcagctgctggtcaccctgagcttcctgcggagcgtcgtcgaggcgcaggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtacttgaaaatggcaaacaataccaaagaattagaagattgtgagcaagctaataaactgggagcaattaacagcacattaagtaatcaaagcaaagaagctttcattgactgggcaagatatgatgattcacgggatcacttttgtgaacttgatgatgagagatctccagctgctcagtatgtagacctattgctgaacccagagcgttacactggctataaagggacctctgcatggagagtgtggaacagcatctatgaagagaactgtttcaagcctcgatctgtttatcgtcctttaaatcctctggcgcctagccgaggcgaagatgatggagaatcattctacacatggctagaaggtttgtgtctggagaaaagagtcttctataagcttatatcgggacttcatgctagcatcaatttacatctatgcgcaaattatcttttggaagaaacctggggtaagcccagttggggacctaatattaaagaattcaaacaccgctttgaccctgtggaaaccaagggagaaggtccaagaaggctcaagaatctttactttttatacttgattgagcttcgagctttgtcaaaggtggctccatattttgagcgctcaattgtcgatctttacactggaaatgcagaagaagatgctgacacaaaaactcttctactgaatatctttcaagatacaaagtcctttcccatgcactttgatgagaaatccatgtttgcaggtgacaaaaaaggggccaagtcactaaaggaggaattccgattacatttcaagaatatctcccgtataatggactgtgttggatgtgacaaatgcagattatggggaaaattacagactcagggtttaggaactgccctgaagatattattctctgaaaaagaaatccaaaagcttccagagaatagtccatctaaaggcttccaactcacccgacaggaaatagttgctcttttaaatgcttttggaaggctttctacaagtataagagacttacagaattttaaagtcttattacaacacagtaggtaataaaggcttttatgtgtctaactagagacataaagtgactgtggaaagccttttaattatggacattcatcagaaagacactaatctgacttcaagaattctgaactattaaatagaaaatttaaatgctcacttgaatatttatgattcttaatagattattatcaactagagatatttataaatgaagtatatacttttaaaacatgtaagttatactaattttgtgtttaatttcatatgttttcatgtaatgaaaattctattttttttagaattggttttgtttttattctattatcctttatttccagttgtcaaactttaaatggctatgtctgcattctaataacactgttcagtctgttatggaaaaggagaactagggaacaaatgttgctcagggctggtgtcagtgagaaaaatttatcaatgctttttaatgtgtttttacccttgcctcactgtgtgtgtgtcactttctataatataaagaaatactataatatttctagaatctggaactgtcaccatgatgaatggccctttcaatgcatagttacagaaattcctgaagattccccaggacttcaatttcattggtttttatttgcagtttttagttgctgtaattgttgctgtttccagtctaaaggacctcctttggtaaaggtgaacaagacctctcccctatgctacccagccagattttgtgtgtgtaatgggctggcccaagagtgttcttttacttagaactccttttgattttgcttttctctgcccctagaaattttagggacaaagacattttggaaattgtcagttacttttagaaagaaaacactgcagaaatatttaacagattacttcttgataaaatttaaatgggattatatgaatttataatgccaattgaaaatattatatacacaaaatttgctattttcacttaaagtaagcatttttaaaggatttattttagaatacaatctatgcaatcctcgaactcagtgtgcttttccctgacaggatatataaaaaggtagattaggtcaaccctcctttaagcttactctcccctcaccttttcttttcactgtatataaacggtactttctgtgattcataccaacagaggactttctgtgattcataccaacagtcctaaactgtcattttctaaatctgggatttaaaatctttagacaatatttaaaatcttgattttttttaaatgtcagcagatacaatttggaagattgcatctgtgtagaagtaatgcaggtacaagatctagagtttttccttagactctttagtcttttctgaattaaagaataagtgctcttaaatccatattttatcctgtcaaagtctgaaatgtgttcattgatgatttggtgacatctaaaaaattgtatttagttggcttggctcacccctcttaaaaatacttagccatctcttggtgggatgtggtgggggtattaaggtctcagagttatttattttctcacctaatttcaaacctttataaacttggggttttgttgttgatggtggtagtattttttgttaagttgtttaaaaggctgacttgattggagcctcctctactttttcttgagggttgcaagtattgtatggtgggggaggggggccttaaggcaaactgtctaaaaagtgactatccaattaatttaactagtaaattagtaagaattattcttagtattcactcagagtttaagatgtgaaaaatctgcactttgtttatcactctaaatgtaaagaactttttgatagtgttatttcaccactccctcagttaaaggctattatttaaactgtttactggagaaaatcctcgctcatgtccatttattgtttttttctgtactgtgatttgtttcaagcttaggaaaactagtatattagagtatgttctaggaaattaaaagatctggttagagtaaaaagttctttttaaggttcttaactaattttttcacaactaagaaaataaatgaagtattcttaggctgaaattcatcttattttatcataaattagattgtaggggcagcctacatttttgtgtatgtgtttttatttcttaaatgattgtgtgagcctggtgacattttatggttcttgtgatctaaactgtttttccaattcacatcttttgtcgtgaagtgatattatactagagtactgtttgcattgtaaaaatgctttgctggtgctctggcattttgtctttatctcatcacctaatttaaaaacccagcacttgataatataactgacagaaatgattgtacccactgatgaagtaatgaaaatgaagaaaaggaaaatattccttccttcaatggcgtaagtttattttttacttaagtggcatctatgtaagttagacaaactatatattaaaattggtaaactttgaatgtttctcctgttttgattcttagattatgaggaggatcagacagaataagactccacacttttgaaatttgataagtcaaaacgttttattttgacatttttaacattgtgaattattcgatatttgtaatctctgtatgtatatgaaactctgccatgtttttcaactttgcctatgtgccactgtatataagaaaggacagctattttgatcttcatcagcattgccttcagctgaaaatttgggaacagttcacagtaaacctctcagtagtttgcaaactgaggtacctgcagaaaccatagctactcaccaaaatacacagattaggtgcatggtatcgtggaaattatttggtaaaaaaacacacacacaaatctatgtgtactgtattttaaggaatatctacaggtgcagctttgattttgaacagaattccaaataatttactgttgtacccaccagaatctagaaaatgtgaattaaagtacatgtttctgcaa

SEQ ID NO: 2127 - DNA, 605 bp, Homo sapiens
ggagggccgggcagggccgggccagaaaagaggtgatttctggcgagcagaaaacccggggagcagagacctgaccgtccagtgcgggaaacatctgcgaaccgcccgcagggtggggggacggcgacactccgggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtacttgaaaatggcaaacaataccaaagaattagaagattgtgagcaagctaataaactgggagcaattaacagcacattaagtaatcaaagcaaagaagctttcattgactgggcaagatatgatgattcacgggatcacttttgtgaacttgatgatgagagatctccagctgctcagtatgtagacctattgctgaacccagagcgttacactggctataa

SEQ ID NO: 2128 - DNA, 1266 bp, Homo sapiens
cgtgaggagggaaggagagatggggggacgtgggacagggagaaaacaacataaatcatatatatatagcatgcaaattggaaggtgatcagcacacaataggcattcaataaatgttgaaataatgacaccccactgtctccttgccctcaaatggtctcccctaacgtatcccctgttgtcttgcttcttctcttcccacttgcagagcctgctgcccacgtctcttccctgagctgcctgctggggtcatggagctgccaacaaagcctggcaccttcgacctgggcctggccacatggagcccttccttccagggggaaacccaccgggctcaggcacgccgcagggatgttggcaggcagctgcctgagtacaaggctgtggtggtgggcgccagtggcgtgggcaagagtgcgctgaccatccagctgaaccaccagtgcttcgtggaggaccacgaccccaccatccaggattcctactggaaggagttgaccctggacagtggggactgcattctgaatgtgctggacacagcagggcaggccatccatagggccctgcgtgaccagtgcctggctgtctgtgatggtgtgctgggcgtcttcgctctcgatgacccctcgtctctgatccagctgcagcagatatgggccacctggggccctcaccccgcccagccccttgtcctcgtgggcaacaagtgtgaccttgtgaccactgctggagatgctcatgccgctgctgcagccctcgcacacagctggggggcccacttcgtggagacctcggccaaaacacggcaaggcgtggaggaggccttttccctgctggtccatgagatccagagggtccaggaggccatggcgaaggagcccatggcaaggtcctgtagggagaagacccggcaccagaaggccacctgccactgtggctgctctgtggcctgaaggtcttggccaagaaatgtagacctttccccaggccagggtgattgttcatttgacatgagacccctgaggcaactagctttgagggacacatcaggtatactagggaaagatggacatctctcttgttttcacttggtgaggggctttttggtaacatgggagtgcctaatgttgcttttgttatgtcaagttgaaagattttgtgcaaaattaaataaatggtgttttgggtttcaaagctgcctccatgccgagtgttgtgtgggtgggagtgagactgggtagaatgttacttgagttgtgagaattc

SEQ ID NO: 2129 - DNA, 5099 bp, Homo sapiens
ggagctcggttggccttgggtgggtctagacagccgcggcggctgcggcgccgatagtgacagtgagtgcgtgagacccggagagaaatggcgatggcgatgtcggacagtggggcgagccgcctgcgtcggcagctggagtcagggggttttgaggcgcggctgtacgtgaagcagctctcgcagcagtcggatggggaccgggacctccaggagcaccggcagcgcatccaggcgctggcggaggagacggcgcagaacctgaagcgcaacgtctaccagaactaccggcagttcatagagacggcccgcgagatctcctacctggagagcgagatgtaccagctcagccatttgctgaccgagcagaaaagcagcctggagagcatcccgcttacgttgctgcctgccgctgctgccgccggagccgccgccgcctctggaggggaggagggagtcggtggggcggggggccgagaccacctccgaggccaggccggctttttctccacccccgggggtgcctcccgcgacggctccggtccaggcgaggaaggaaagcagcgcactctcaccaccctgcttgagaaggtggaaggctgcaggcatctgctggagacgccgggacagtacttggtgtacaatggggacctagtggaatacgatgcggaccacatggcccaactgcagcgggtgcacggctttctcatgaacgattgcttgttggtggctacctggctgcctcagcggcgtgggatgtatcgctacaacgctctctattccctagatggtttggccgtagtcaatgtcaaggacaacccgcccatgaaggacatgttcaagctgcttatgttccccgagagccgtattttccaggccgaaaatgctaaaatcaaacgagagtggctggaagtgctggaggacaccaagagggccctcagtgagaaaaggcgaagggagcaggaggaggcagcggcccctcgagggccaccccaagtgacttccaaggccactaacccatttgaggatgacgaagaagaagaaccagctgttcctgaggtagaggaagagaaggtggacctctccatggaatggatccaggagttacctgaagacctggatgtctgcattgcgcagagagactttgaaggggcggttgacctgctggataaattgaaccattacctggaagataaacctagcccacctcctgtaaaagaactaagggccaaagtggaggagcgagttcgacagctcactgaggtgctagttttcgaactctccccagatcgttccctgagaggtggtccgaaggctactcgcagagcagtttcgcaactgatccggctgggccagtgcacgaaggcctgtgagctatttttgagaaacagggcagccgctgttcatactgcaattcgtcagcttcgcatcgaaggtgccactttactctatattcataagctgtgccatgtcttctttaccagccttctcgagactgcaagagaatttgagatcgattttgcaggcactgacagcggctgctactctgcctttgtggtctgggcaagatcagccatgggcatgttcgtggatgcttttagcaagcaggtgtttgatagtaaggagagcctctctacagcagctgagtgtgtaaaagtggctaaggagcattgccagcaactgggtgatatcggactggatctcaccttcatcatccatgcccttctggtgaaagacatccaaggggccttgcacagttacaaagaaatcatcattgaagccactaaacatcgcaactctgaagagatgtggaggaggatgaacttgatgacgccagaagccctgggtaagctcaaagaagagatgaaaagttgtggggtaagtaactttgagcagtacacaggggatgactgctgggtgaacctaagttacacagtggttgctttcaccaaacagaccatgggcttcttggaagaggccctgaagctgtatttcccagagctgcacatggtacttttggagagcctggtggaaatcattttggttgctgttcagcatgtggattatagtcttcgatgtgagcaggatccagagaagaaagcttttatcagacagaatgcatcctttttatatgaaacagtcctccctgtggtggagaaaaggtttgaagaaggtgtggggaaacctgccaagcaactccaagatctgaggaatgcatctagacttattcgtgtgaatcctgaaagtacaacatcagtggtctaatgcttgggtctgtttatatgtgtatatatgcagagagagagcttatatattatttatatttatattaagttgtattagcatactctatagtttcaaacacaacttgaaaattaaaagtgccctcttaaaaatacaaaaatcaaaaagaggaaaataagttaaattaagcccaagtaacaaaaatactggaattattaaaacgtatagtatgctagctatccttttaaattatgctaattctcttcttctgaaattatggtcacactatatactatagcatttcggttttatcctttgataaaacttttcttttttcttttttttttttgagacagggtctcaccccgtcgcacaggctggagtgcagtggcaaagtctcgactcactgcagccttgacctcccgggcccaggtagtcctcccacctcagcctcccatgtagcaggaaccacaggcaggcaccaccatacccagctaatttttgtattttttgtagagatggggtttcgccatgttgcccaggctagtcttttctttcttctttttttttttccccacagtatatattatacagcagtcataatatctataaatacatagagtttatgttgtgaagtttcccagttcactgaaatgttaggtttcctaaagggtacagtgccgtataaaacaacctgcctcatatatttctcctcaaaacgttggactatttgggaaaaggaaaagagttgggaaaattggttttaaggtaagttttagtcaaaagaattctttcttgaaactagctggtttgtggattcagatactctgatccttacagaatccaagaggaagctttcataaaaacaattcagcaaatatttccaatataatttgaatggctaattttcagttgctaattaattagcagctttgtaatacttgatttgggagcatttacttggaaatcctaaggactataataaaagttttcaacatatttctaaattgtgtgagtttccagctgtagcttttgtctttgtcacattttaaaaaataataagcaagacacattggggacactggcagcagttgccaggttttagctgccaccgcttcagtatgagatatagctgtcccatcttcccccattcagggtaggagatatagtgacccagacttcatgcaaatggaaaaaaagttttaactgaaatatttatttagatttcagggtctagatggatgggaaagtagaaaaacatatgcaaatctcagtgttctcactatgaccactctgagcagagatttggttttgtttccttttgtaacaaagtgaaaacaggtgagacaatgtgcccaaaacaaagggaagaagagaaccttctgtgactcctaaaatgttccatgctgcatttttgtttcattttttatttttccttgctttgtttttaaacatgaatataatgcttacttcaaattgtttagtaaaacaaaataactaaagaaatgtgagcttcccaaggtttctaaactatcgctgttgtatattctatagcgttccttattctttgagggaaactgtgcttgctgtgatccattttgtctctagcttctagttgtgattcttgtccataagcaccaaatttgatgcccatgatttcaaaaggtcatttcttttatctgaatgaaaatggtggtactaagactgtgaaaattatgtgaaacctaaagtagttgccaaagtggctcagggttgtaaaattcattgacttaattattcatgtgccagatcaacccctttattttctctttagctgtgcatatttaaaatattggaaagtatcagatttacagattttctttgactaatttttttcacataactttaggattttcgaaagttgtaaccataactggatatcttagctgagcaaaggcggttataatttgtctttttaagatcactggaaattgataaaattttgtgataattatgattattctgtgccatttacagtttctaatactatactgtatgaaatatgtataaatatatgatgctgagtctgtggaatgatacttctgaaatcaaaattcctcataaggcatgaagttgtaaaaacttgaatgtgtatagttagatatttaaatggttgcttcttcatagaattgtctgctttttaaaactggaagtacaggattttcttcaggtaaaatctgtgtgttccaattacagttgtagctgaaggaagtatgctttggtgagtcaattagtatgggaacttgactaaagacccccagtgttgtaacgtacctttgtacccagacaaaacaattatgttacattcctcaaagtggcatgggctttcttctctaattcttctgttttattagacccaagacaagttctaaaaattgaatgcaatgagagattgtccagaaatgtaatatatactaaaatataccacttaagcattgattgccttttcttgtttgcttcaagaatataaaacttgttacttgagcttggaatcatgggcttgattgaattaattactcttggggaaaaaagacaccttgtggcattaagtcttgctttggttaaagccttatttcacataattgctaaaaactcatttttgtttaatatactacctatagtttaattatcggcacttgtattttgtaacttgatatcttacctaggattgggaatttgggacatgacatgtactataaaagtcagtctatgtacatactgcttattgatgtgctgtgatatgagggaatctgaaatgtttcataaaaataaagcttaaaaattgtcttacactggataaaagtgatattaagata

SEQ ID NO: 2130 - DNA, 5100 bp, Homo sapiens
attcctgcttcctcagcccaggagctcggttggccttgggtgggtctagacagccgcggcggctgcggcgccgatagtgacagtgagtgcgtgagacccggagagaaatggcgatggcgatgtcggacagtggggcgagccgcctgcgtcggcagctggagtcagggggttttgaggcgcggctgtacgtgaagcagctctcgcagcagtcggatggggaccgggacctccaggagcaccggcagcgcatccaggcgctggcggaggagacggcgcagaacctgaagcgcaacgtctaccagaactaccggcagttcatagagacggcccgcgagatctcctacctggagagcgagatgtaccagctcagccatttgctgaccgagcagaaaagcagcctggagagcatcccgcttacgttgctgcctgccgctgctgccgccggagccgccgccgcctctggaggggaggagggagtcggtggggcggggggccgagaccacctccgaggccaggccggctttttctccacccccgggggtgcctcccgcgacggctccggtccaggcgaggaaggaaagcagcgcactctcaccaccctgcttgagaaggtggaaggctgcaggcatctgctggagacgccgggacagtacttggtgtacaatggggacctagtggaatacgatgcggaccacatggcccaactgcagcgggtgcacggctttctcatgaacgattgcttgttggtggctacctggctgcctcagcggcgtgggatgtatcgctacaacgctctctattccctagatggtttggccgtagtcaatgtcaaggacaacccgcccatgaaggacatgttcaagctgcttatgttccccgagagccgtattttccaggccgaaaatgctaaaatcaaacgagagtggctggaagtgctggaggacaccaagagggccctcagtgagaaaaggcgaagggagcaggaggaggcagcggcccctcgagggccaccccaagtgacttccaaggccactaacccatttgaggatgacgaagaagaagaaccagctgttcctgaggtagaggaagagaaggtggacctctccatggaatggatccaggagttacctgaagacctggatgtctgcattgcgcagagagactttgaaggggcggttgacctgctggataaattgaaccattacctggaagataaacctagcccacctcctgtaaaagaactaagggccaaagtggaggagcgagttcgacagctcactgaggtgctagttttcgaactctccccagatcgttccctgagaggtggtccgaaggctactcgcagagcagtttcgcaactgatccggctgggccagtgcacgaaggcctgtgagctatttttgagaaacagggcagccgctgttcatactgcaattcgtcagcttcgcatcgaaggtgccactttactctatattcataagctgtgccatgtcttctttaccagccttctcgagactgcaagagaatttgagatcgattttgcaggcactgacagcggctgctactctgcctttgtggtctgggcaagatcagccatgggcatgttcgtggatgcttttagcaagcaggtgtttgatagtaaggagagcctctctacagcagctgagtgtgtaaaagtggctaaggagcattgccagcaactgggtgatatcggactggatctcaccttcatcatccatgcccttctggtgaaagacatccaaggggccttgcacagttacaaagaaatcatcattgaagccactaaacatcgcaactctgaagagatgtggaggaggatgaacttgatgacgccagaagccctgggtaagctcaaagaagagatgaaaagttgtggggtaagtaactttgagcagtacacaggggatgactgctgggtgaacctaagttacacagtggttgctttcaccaaacagaccatgggcttcttggaagaggccctgaagctgtatttcccagagctgcacatggtacttttggagagcctggtggaaatcattttggttgctgttcagcatgtggattatagtcttcgatgtgagcaggatccagagaagaaagcttttatcagacagaatgcatcctttttatatgaaacagtcctccctgtggtggagaaaaggtttgaagaaggtgtggggaaacctgccaagcaactccaagatctgaggaatgcatctagacttattcgtgtgaatcctgaaagtacaacatcagtggtctaatgcttgggtctgtttatatgtgtatatatgcagagagagagcttatatattatttatatttatattaagttgtattagcatactctatagtttcaaacacaacttgaaaattaaaagtgccctcttaaaaatacaaaaatcaaaaagaggaaaataagttaaattaagcccaagtaacaaaaatactggaattattaaaacgtatagtatgctagctatccttttaaattatgctaattctcttcttctgaaattatggtcacactatatactatagcatttcggttttatcctttgataaaacttttcttttttcttttttttttttgagacagggtctcaccccgtcgcacaggctggagtgcagtggcaaagtctcgactcactgcagccttgacctcccgggcccaggtagtcctcccacctcagcctcccatgtagcaggaaccacaggcaggcaccaccatacccagctaatttttgtattttttgtagagatggggtttcgccatgttgcccaggctagtcttttctttcttctttttttttttccccacagtatatattatacagcagtcataatatctataaatacatagagtttatgttgtgaagtttcccagttcactgaaatgttaggtttcctaaagggtacagtgccgtataaaacaacctgcctcatatatttctcctcaaaacgttggactatttgggaaaaggaaaagagttgggaaaattggttttaaggtaagttttagtcaaaagaattctttcttgaaactagctggtttgtggattcagatactctgatccttacagaatccaagaggaagctttcataaaaacaattcagcaaatatttccaatataatttgaatggctaattttcagttgctaattaattagcagctttgtaatacttgatttgggagcatttacttggaaatcctaaggactataataaaagttttcaacatatttctaaattgtgtgagtttccagctgtagcttttgtctttgtcacattttaaaaaataataagcaagacacattggggacactggcagcagttgccaggttttagctgccaccgcttcagtatgagatatagctgtcccatcttcccccattcagggtaggagatatagtgacccagacttcatgcaaatggaaaaaaagttttaactgaaatatttatttagatttcagggtctagatggatgggaaagtagaaaaacatatgcaaatctcagtgttctcactatgaccactctgagcagagatttggttttgtttccttttgtaacaaagtgaaaacaggtgagacaatgtgcccaaaacaaagggaagaagagaaccttctgtgactcctaaaatgttccatgctgcatttttgtttcattttttatttttccttgctttgtttttaaacatgaatataatgcttacttcaaattgtttagtaaaacaaaataactaaagaaatgtgagcttcccaaggtttctaaactatcgctgttgtatattctatagcgttccttattctttgagggaaactgtgcttgctgtgatccattttgtctctagcttctagttgtgattcttgtccataagcaccaaatttgatgcccatgatttcaaaaggtcatttcttttatctgaatgaaaatggtggtactaagactgtgaaaattatgtgaaacctaaagtagttgccaaagtggctcagggttgtaaaattcattgacttaattattcatgtgccagatcaacccctttattttctctttagctgtgcatatttaaaatattggaaagtatcagatttacagattttctttgactaatttttttcacataactttaggattttcgaaagttgtaaccataactggatatcttagctgagcaaaggcggttataatttgtctttttaagatcactggaaattgataaaattttgtgataattatgattattctgtgccatttacagtttctaatactatactgtatgaaatatgtataaatatatgatgctgagtctgtggaatgatacttctgaaatcaaaattcctcataaggcatgaagttgtaaaaacttgaatgtgtatagttagatatttaaatggttgcttcttcatagaattgtctgctttttaaaactggaagtacaggattttcttcaggtaaaatctgtgtgttccaattacagttgtagctgaaggaagtatgctttggtgagtcaattagtatgggaacttgactaaagacccccagtgttgtaacgtacctttgtacccagacaaaacaattatgttacattcctcaaagtggcatgggctttcttctctaattcttctgttttattagacccaagacaagttctaaaaattgaatgcaatgagagattgtccagaaatgtaatatatactaaaatataccacttaagcattgattgccttttcttgtttgcttcaagaatataaaacttgttacttgagcttggaatcatgggcttgattgaattaattactcttggggaaaaaagacaccttgtggcattaagtcttgctttggttaaagccttatttcacataattgctaaaaactcatttttgtttaatatactacctatagtttaattatcggcacttgtattttgtaacttgatatcttacctaggattgggaatttgggacatgacatgtactataaaagtcagtctatgtacatactgcttattgatgtgctgtgatatgagggaatctgaaatgtttcataaaaataaagcttaaaaattgtcttacactgga

SEQ ID NO: 2131 - DNA, 3577 bp, Homo sapiens
aggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctatggtgacctctgaattgtacccaccacagctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttcc

SEQ ID NO: 2132 - DNA, 4388 bp, Homo sapiens
atcttggccttcgggcccaatcagggaggccctacctatccgaaacccggtccgttccccgcggaagaggggtggagtttcaaccttttaactccaccttggtctgtgcagcgcggaccaacccaaatcgccagaaaggaggggcgtggcttgaagtcccctcctccatcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactcaaa

SEQ ID NO: 2133 - DNA, 4047 bp, Homo sapiens
aagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactcaaacc

SEQ ID NO: 2134 - DNA, 3727 bp, Homo sapiens
aggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctatggtgacctctgaattgtacccaccacagctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggatcttacattaaacatcatactc

SEQ ID NO: 2135 - DNA, 4407 bp, Homo sapiens
ggtgcatttccaggcgctgctctccgtcgcagagaaccctgagctcggcgcgccgagagtcccagcagggcaagggggcgcggcgtcctggtcctcgagcttgggagacagatgcgcatgggcgtgggggcatgcggacctaagctcgggtgaagctctcgggaagggcaagactgcggcgacgagatgcgagcagaggagccctgcgcccccggggcccccagcgccctgggagcccagcgcacgccgggccccgagctgcgcctgtccagccagctgctgcccgagctctgtaccttcgtggtgcgcgtgctgttctacctggggcctgtctacctagctggctacctggggctcagcataacctggttgctgctcggcgccctgctgtggatgtggtggcgcaggaaccgccgcgggaagcttgggcgcctggccgccgccttcgaattccttgacaatgaacgcgagttcatcagccgcgagctgcggggccagcacctgccagcctggatccacttcccggacgtggagcgggtcgagtgggccaacaagatcatctctcagacctggccctacctaagcatgatcatggaaagcaagttccgggagaaacttgagcccaagatccgagagaagagcatccacctgaggacctttacctttaccaagctctactttggacagaagtgtcccagggtcaacggtgtcaaggcacacactaatacgtgcaaccgaagacgtgtgactgtggacctgcagatctgctacatcggggactgtgagatcagtgtggagctgcagaagattcaggctggtgtgaacgggatccagttgcagggcaccctgcgggtcatcctggagcccctcctagtggacaagccctttgtgggagccgtgactgtgttcttccttcagaagccgcacctacagatcaactggactggcctgaccaacctgctggatgcgccgggaatcaatgatgtgtcagacagcttactggaggacctcattgccacccacctggtgctgcccaaccgtgtgactgtgcctgtgaagaaggggctggatctgaccaacctgcgcttccctctgccctgtggggtgatcagagtgcacttgctggaggcagagcagctggcccagaaggacaactttctggggctccgaggcaagtcagatccctacgccaaggtgagcatcggcctacagcatttccggagtaggaccatctacaggaacctgaaccccacctggaacgaagtgtttgagttcatggtgtacgaagtccctggacaggacctggaggtagacctgtatgatgaggataccgacagggatgacttcctgggcagcctgcagatctgccttggagatgtcatgaccaacagagtggtggatgagtggtttgtcctgaatgacacaaccagcgggcggctgcacctgcggctggagtggctttcattgcttactgaccaagaagttctgactgaggaccatggtggcctttccactgccattctcgtggtcttcttggagagtgcctgcaacttgccgagaaacccttttgactacctgaatggtgaatatcgagccaaaaaactctccaggtttgccagaaacaaggtcagcaaagacccttcttcctatgtcaaactatctgtaggcaagaagacacatacaagtaagacctgtccccacaacaaggaccctgtgtggagccaggtgttctccttctttgtgcacaatgtggccactgagcggctccatctgaaggtgcttgatgatgaccaggagtgtgctctgggaatgctggaggtccccctgtgccagatcctcccctatgctgacctcactcttgagcagcgctttcagctggaccactcaggcctggacagcctcatctccatgaggctggtgcttcggttcctgcaagtggaggaacgagagctggggagcccatacacaggacctgaagccctaaagaaaggccctctgctcatcaagaaagtggctaccaaccagggtcccaaagcccaacctcaggaagaaggccctacagatttgccatgtcccccagaccctgcttctgatactaaggacgtatccaggagtaccacaaccaccaccagtgctaccaccgttgccactgagcccacatcccaagagacaggcccagagcctaaaggcaaggacagtgccaaaaggttctgtgagcccatcggggagaagaagagtccagccaccatcttcctgactgtcccaggtccccactctccagggcccatcaagtcacccagacccatgaaatgccctgcctccccattcgcatggccgcccaagaggctggctcccagcatgtcctcgctcaactccttggcctcttcttgctttgacctggcagatatcagcctcaacattgaaggtggggacctcaggcgacggcagctgggtgagattcagctcacagtgcgctatgtgtgtctgcggcgctgcctcagcgtgctaatcaatggctgcagaaacctaacaccatgtaccagcagtggagctgatccctacgtccgtgtctacttgttgccagaaaggaagtgggcatgtcgtaagaagacttcagtgaagcggaagaccttggaacccctgtttgatgagacatttgaattttttgttcccatggaagaagtaaagaagaggtcactagatgttgcagtgaaaaatagtaggccacttggctcacacagaagaaaggagttaggaaaagtactgattgacttatcaaaagaagatctgattaagggcttttcacaatggtatgagctgactccaaatggacagcccagaagctgatgatgagaattcttatcactcacctttatattaaaatgtatatatatgtatatattttttcctttggatcacttacatccaatatatgtatattttgtcatttaaatcagaacaaccacttgaaattatatacatacaattcttgtgtggaatttaactccatgactgaatagcataaggaagaggttatttaaaagcaagaactactttttttggttggatttttttgttcaagtccagaaagaaatgttatatttgtgcctactaaattatccaaacctcagtgtttatatacttaaacaagtgccactttttagtaggtaattatataccatctgatttaggacttacctgaatgtatgtaccagaaagtgtcctgcctctggcataggggctgggggaggtctgtttctggagccactaccagcattcctgggcagtgactggccaaagggaagtcacttttttatggaaatagaaagtgacccaactcaaaactgccaagagctaacactgccaaagcccttctggctgccacctgtggtacttgtatgcctggatatttgttcttttatttgacctggagctaaaaatgtatttccctactggcaaaaatgttatactgatatacttaaataccttgagttaaatactcttgtgtagtctaagggccaaactccagcgtgtagcattatttccataggaaaatgcaaaccaagttccaagcccaggtctatgtctgactctcatagcaaagcactggagactgctgaagagtgtcaccatcagagaaaaggaagctttcagataagtttaggctattcaacttttctaaagagatggttggttcacctaaataacatgttaaaagcaaagtattaaattatatgcttaaacaagcgcctcttttacatttcagactttacaagaccaaatatacttctcatcccctccaacattcctggacctcctcttctctcttaccaacaccaacactacctgccgtcagttttctgtctctgcctctgccttcactgccacttttctgaagcagggcaacattcgagaacaaagttttgtcatgttactcttattccagtttcctgccatctgattcacatgcagatgttctattccagagtagtccaaatactatgctctgctgactcaagtcatgtctcaaacctatttcctctattaagtaagtcagtcaatccatagtgaaatggactcttcctaccgcctgtagcatttactgttgatactgagtattttccattttaatagttcccagcctttataacactaagttttaagaaatgttgattaggcatctgctaaggttacatgctaagcagctacttatattgtatttggtatttaattttgtttattctccagttgaacagtagggaacaattcaagctacttgaattgtttttcaccctcaccatccaagaccgtgttaagtacatagaagatgcatggtgaaattcgtttctgctgaggtttctattttaaatggcaaattctcataataaaatggagcattgatgccta

SEQ ID NO: 2136 - DNA, 7580 bp, Homo sapiens
gcgccatgctgcgcctggggctgtgcgcggcggcgctgctgtgcgtgtgccggccgggtgccgtgcgtgccgactgctggctcattgagggcgacaagggctacgtgtggctggccatctgcagccagaaccagccgccctacgagaccatcccgcagcacatcaatagcaccgtgcacgacctgcggctcaacgagaacaagctcaaagccgtgctctactcctcgctcaaccgctttgggaacctcaccgacctcaacctcaccaagaacgagatctcctacatcgaggacggtgccttcctgggccagtcgagcctgcaggtcctgcagctgggctacaacaagctcagcaacctgacggagggcatgctgcgaggcatgagccgcctgcagttcctctttgtccagcacaacctcatcgaggtggtgacgcccaccgccttctccgagtgcccgagcctcatcagcatcgacctgtcctccaaccgcctcagccgcctggacggtgccacctttgccagcctcgccagcctgatggtgtgtgagctggccggcaaccccttcaactgtgagtgcgacctcttcggcttcctggcctggctggtggtcttcaacaacgtcaccaagaactacgaccgcctgcagtgtgagtcgccgcgggagtttgccggctacccgctgctggtgccccggccctaccacagcctcaacgccatcaccgtactccaggccaagtgtcggaatggctcgctgcccgcccggcccgtgagccaccccacgccctactccaccgacgcccagagggagccagacgagaactcgggcttcaaccccgacgagatcctttcggtggagccgccggcctcgtccaccacggatgcgtcggcagggccagccatcaagctgcaccacgtcacgttcacctcggccaccctggtggtcatcatcccacacccctacagcaagatgtacatcctcgtgcagtacaacaacagctacttctccgacgtcatgaccctcaagaacaagaaggagatcgtgacgctggacaaactgcgggcgcacactgagtacaccttctgcgtgacctcgctgcgcaacagccgccgcttcaaccacacctgcctgaccttcaccacgcgggaccccgtccccggagacttggcgcccagcacctccaccaccacccactacatcatgaccatcctgggctgcctctttggcatggttatcgtgctgggagccgtgtactactgcctgcgcaagcggcgcatgcaggaggagaagcagaagtctgtcaacgtcaagaagaccatcctggagatgcgctacggggctgatgtggatgccggctccattgtgcacgccgcccagaagctgggcgagcctcccgtgctgcccgtatctcgcatggcctccatcccctccatgatcggggagaagctgcccaccgccaaggggttggaggccgggctggacacacccaaggtagccaccaaaggcaactatatcgaggtgcgcacaggcgccggcggggacggtctggctcggcccgaggatgacctcccggacctcgagaacggccagggctcggctgcagagatctccaccattgccaaggaggtggacaaggtcaaccagatcattaacaactgcatcgatgctctcaagctggactcggcctcttttctgggaggcggcagcagcagtggggaccccgagctggccttcgagtgccagtccctccctgcagctgctgccgcctcctcagccactggccccggggccctggagcggcccagcttcctttcgcctccctacaaggagagctcccaccacccactacagcgccagctgagcgccgacgcggccgtgacccgcaagacctgcagcgtgtcgtccagtggttccatcaagagcgccaaggtctttagcctggacgtgcccgaccatccggccgccacagggctggctaagggcgactccaagtacatcgagaagggcagccccctcaacagcccgctggaccggctcccgctggtgccggcgggcagcggcgggggcagcggcgggggcgggggcatccaccacctggaggtgaagccggcctaccactgcagcgagcaccggcacagctttcccgccctgtactacgaggagggtgccgacagcctgagccagcgcgtgtccttcctcaagccgctgacccgctccaagcgtgactccacctactcgcagctctcccccagacactactactcagggtactcctccagccccgagtactcatccgagagcacgcacaagatctgggagcgcttccggccctacaagaagcaccaccgggaggaggtgtacatggccgccggtcacgccctgcgcaagaaggtccagttcgccaaggacgaggatctgcatgacatccttgattactggaagggggtctccgcccagcagaagctgtgaccccccccttcctccctggtgaggtcggagccagagggctgggggccttttgggggaagggtccaggcggccagggcggggagcagactcgggggccaaggcccaggagaggacgcacatgcagacccgcacgcacgcacgcacacacacacctgaccaccacccgactgtgaacaaaccaacatccgacaataacggacaggaaaacagagacacattttccttaaagtttacaaactgataccgaaaccagtcgtctttactgtgctgcccagggactctgctggggtgtgcagggccggggggctggcggggggaggaaggaagccaagagagggtgtggggtctggggggtctggggctagaaacaggtgtgggggtcaagaaagctggagtagagagggactgaagcccctctagggcagggagagggtcccttcccaagctgggagtcaagtcacctgcagatttagcattagacatcgggcaatgtctccttccactttagagagggggggaaactgaggcccagagaagggagttgacaaccccagggtcacacagcagcttagcctcaagtcccccaacttcccagcccagtgctgtcccggaaccccctgcagctctcttgtggacccctgcccgccctgtgcccaccccacatccctttccgaagctgtggtcccttggggctgagggacttgggaatcaggcaggtgctttttcttcctagaaagccacatggcagtgcccccagagtgtgcagctgtgattcagaatcctggggggcttttgacccctatgccggcacccgggagaagggagagggtcctgttgacgggaaaggagccgaggcagggcgacattccaccagcccacttcaagtgtcttccacgtggcctgggaagagtggggcgtgtggcgggcaggccagctcccaggacgtctcaggtgcaggctcccggccccagcttctctggtcctccgagacccctgcccaccgcagaagggcagcggtgcactgtgatgcctggagggctgcagggaggagctgtcatgggggacttcctgcctgtccccatggcctgtgtccccacctgcccgaccccatcgtgggatctcggctcctatctcagccgcccacccggggaaggagggctttctcacccatcccctctgggctgctcatccaggcctggccccctggccagaggggctcccatgtttccgtggcaatggccacttccctctttctgacccccccacccaacatcaaacaaagcacaaacagtgaggcccccacccgagagagggttgaggagcaggctgggttcgtggcgccccagcccctcccagccagcctctgtcaccatggtaaccctgtgcctggcagttggtgcccagagtgaccgttgggctctggggttctctgtccatgtaggcggtggcagagggtggtgagggagggccagcctggcagcagctcctggggccagctcttttgggaagcaaatctgcggtcctgagactggggtcttgaccagtcaggatgctgatgggccggagtccatcatccttcacctctgggtgggagctggcccagcggggtgtggggacgcctctactagcagctttgcccgcctagcaacatgtcgcttggctgccacccacctcagcttggggggccccggctctccccacgcccctgccagagacccccagtctagggcctgtggcccacatgggtttcctgagatttggggagtgtgactgaggggcgagggtaggcactggaatgggtccaagaccggcactgttggtgggcaggggctctgaccaggaaagctagtgccatcccctggggaccccaacgaccttcctgctgggggcagggggtgagggaggacagcagagggctaggaggctcgggctcagctgagtacctctctcacaccaactttggggttaacgaagcccagggctcactttgagggtgacatttgcaaagaaaagactgttctcctggggcgaggaggggagggggcggcatggatacgcggagcagacctcctcccccggcccccaaaacctgccccccaacccctcctcacacccccttggcacaactgagaaaagcaagcaggcagagaagccaggggtgtgaggaagcagactccctgttatatttgcatgacgattttactgtatttttctgagcaaacatctgtcgtgtatgtgccagtttgtccagactcccccgccccctctctgatgccctgctttcccacattctgtctgttgtgatctgacgagcagctcttgaaacccagggaggggtcagctctgcaaaaacagacccaaaacaggtgccaccaagacacagccctgccccacacccacctcctgtgtttctgagcattgggcccatgtgccacctcccttcctccctccctctctccactgccacctcccttgtccccagttccttcccctcctccatgccagggagggcagccccagggaagcctcctcaagggctcttgtcccggtggaagggactgtctgtccgtcccgcttgttcccgttttgtagatgaggaagtcagggctcccagacgggcctggtgaattggctggccagctggggtggaggatcagtcacactgctgagtgtaggaggccaggagcttggggcttcgtggggggcttcagggagagggtgggggctttgagaaaggaacccgtgggaagaaggagcacgcctgggctgggccccagggagggttcccagcagcaggagttaggggcctgcgcttgccatttccccatcctttctgcgtgaagatatttaggaaacctcagactctctgactgcagggacaggggcccttccaaagagcaggactctgatgatccaggaggggaactggccttgaagacccagttcatgtggttctttgtgaggcagagcggggtctaagactcgggtctctggcctcccagccaggccagagccccaactgctcagcttggggagagcccacccggaggctggcctgcatctgtgtcccacgtcctgctcaggatgagtttttcccaggcgggagggaagtattcacaaaatgttgccatccaaggtctgggtttgtgatgatgatgagcatggtggagctgggctgtggtctggggcaggccagcagggcagacaccaggaaaagagggcagggggggccacagggagggaggggagatggaggcccggtggagcgagggatgtgtgggtgccacgccctggacctctgcggggaggcctcctgccttgggccggaacaaggtcacacctgggcttgcctgcctctgttggagaatctcctctgaagctgtttctgggaagtagcacaatgggtctgctccttcctgggagggcacagcaggtgcagctaaccctctgttggagcttatggccttccagtagcaaaacacagaggtctggcatgaaggcaagaaagcctggttggtggggaaacctcgtcacgggtcccggccttgcttttccccgcggcaggaagagtctctctctgcccaccaaagaatccctcacctgggctcccctcctgaggcagtgcaggaggcctgtgggagcagcctgtgtccaggctggggagcccgtgtctgggtaggtctgggaaaagggctgtcaggggagcgaggagggtgggagtaaagagacctgcttgggaaggccaggcctggatcgtccccgggaggcagctggggcagcagcagtggggagtatcaggctggccgagagtcacccatgttctcaactggaagttggtcgcctgccccactccctcctggaaatgtaacagcggggtgaacagaagtgcagagacggaaaggagaggaaaggagacctagagctgacaaactcggttgtgacagtgctgaggccgggatggcatcaggaattaaggacaccagtgacaggtcctagcttataaggggcctaagtgcagggaagggataagacacaatgctccctagtgactggcgccttgcagaaaattaaaatagggtgatgggggaggggcaaggctggtcagggagcatcctgtgtgggatggggggacagggagccaagctgtgaatgacaagaggagccagaagggtgggtgggtgggtgggtgtgaagacgagactagagggagtggggttgcagtggctgcctgtcccccaagcaccgcctctgtcccctactaccctgcccctgcccattcctggcccagcagagccccctttccatgagtgtggatgggcggggcaagccgtcggggagcctggggaagctcagccctgaggggcttactttgcccgtggaagccagtgtgaaggttagggcagccttgcctggctggccccattgccacctctcctgtctgacaaggtggctgctccagaggtggctgagccccaggagaggggacctcctctaactctcatgctcagattccatcctgacacactccttccctgaccctgggtgccccttctaagacaaaaccagggtccatactgcttgcctccagaggcggcttcaggcctcactaaaggtcaggcagtcctgctgagcaggagggagaggaagggggtcctgtaggacgggcaggatggtctgggcctgctcctccttcctctgcccctctgccactccacactccagcacagggctgggacaggggcttggagttcctgcagtggcggccacacttccctccctccctcccttcctcaggagccgccagtccccaagttggctgtggttgggcacctggtttgggtcctgcagagctgggctcaggccctgggctctgaacctgtgaacccttgctgtgttacgaaactttccttcctctgagggccttgaaccctctccttttcttcttttgggggtgggggttaactttattttctcttccctgtatctgcctctcccttccctcaatttcctgttttaaaactgaatggcacgaaattgttttcctcaactcggagattcctgtatggagagaatcaatttctatatttgcaataaatttcttatttaaagcta

SEQ ID NO: 2137 - DNA, 8360 bp, Homo sapiens
cacacgcgcgctcccagacacacacacagacacacgcgggccaccccacggccacgcaccccgcacccacacccgcgctcacactcacattcacactcacactcacacgcgcaggccccgcggccgccgcttcccggaggcggtgcttggcccggatcccggctggggctgggaaggagaggacttgggtgaggagctgctgccacccgggctgggccaggacctgagatctcattgctactgctgccgctgctgcctggggaacctttctgagacccaggttggggacagtgccggaggggcctcctctgctgcagacatctggaaccaggtgcagatgggtctcttccttcctgcccccatctctctcactcctggctcagtgcggcactctccagcctcctgtgggaatcatctgaagttctgagcccggaagccaaggaggaagacgaggaggaggaggaggaggaggaggaggaggagggagaggaagtcaagccctgagaacccttgcaccttcctagcaggagacaaggagcaacgctgcggtggggagcaggctgtggggcccccacccccagccctagccaggcctagtgcctgctgtagcaccctagaagatccccagcagttggcactagctgtacccaccttgcctggggcccccgtgctgggggtcgcccccaagatggtggcggccccagggaggactgtactgccagccccagcctctggccgctaggcaccccctgccttgccctggcccctcactccgaggccagcgccatgctgcgcctggggctgtgcgcggcggcgctgctgtgcgtgtgccggccgggtgccgtgcgtgccgactgctggctcattgagggcgacaagggctacgtgtggctggccatctgcagccagaaccagccgccctacgagaccatcccgcagcacatcaatagcaccgtgcacgacctgcggctcaacgagaacaagctcaaagccgtgctctactcctcgctcaaccgctttgggaacctcaccgacctcaacctcaccaagaacgagatctcctacatcgaggacggtgccttcctgggccagtcgagcctgcaggtcctgcagctgggctacaacaagctcagcaacctgacggagggcatgctgcgaggcatgagccgcctgcagttcctctttgtccagcacaacctcatcgaggtggtgacgcccaccgccttctccgagtgcccgagcctcatcagcatcgacctgtcctccaaccgcctcagccgcctggacggtgccacctttgccagcctcgccagcctgatggtgtgtgagctggccggcaaccccttcaactgtgagtgcgacctcttcggcttcctggcctggctggtggtcttcaacaacgtcaccaagaactacgaccgcctgcagtgtgagtcgccgcgggagtttgccggctacccgctgctggtgccccggccctaccacagcctcaacgccatcaccgtactccaggccaagtgtcggaatggctcgctgcccgcccggcccgtgagccaccccacgccctactccaccgacgcccagagggagccagacgagaactcgggcttcaaccccgacgagatcctttcggtggagccgccggcctcgtccaccacggatgcgtcggcagggccagccatcaagctgcaccacgtcacgttcacctcggccaccctggtggtcatcatcccacacccctacagcaagatgtacatcctcgtgcagtacaacaacagctacttctccgacgtcatgaccctcaagaacaagaaggagatcgtgacgctggacaaactgcgggcgcacactgagtacaccttctgcgtgacctcgctgcgcaacagccgccgcttcaaccacacctgcctgaccttcaccacgcgggaccccgtccccggagacttggcgcccagcacctccaccaccacccactacatcatgaccatcctgggctgcctctttggcatggttatcgtgctgggagccgtgtactactgcctgcgcaagcggcgcatgcaggaggagaagcagaagtctgtcaacgtcaagaagaccatcctggagatgcgctacggggctgatgtggatgccggctccattgtgcacgccgcccagaagctgggcgagcctcccgtgctgcccgtatctcgcatggcctccatcccctccatgatcggggagaagctgcccaccgccaaggggttggaggccgggctggacacacccaaggtagccaccaaaggcaactatatcgaggtgcgcacaggcgccggcggggacggtctggctcggcccgaggatgacctcccggacctcgagaacggccagggctcggctgcagagatctccaccattgccaaggaggtggacaaggtcaaccagatcattaacaactgcatcgatgctctcaagctggactcggcctcttttctgggaggcggcagcagcagtggggaccccgagctggccttcgagtgccagtccctccctgcagctgctgccgcctcctcagccactggccccggggccctggagcggcccagcttcctttcgcctccctacaaggagagctcccaccacccactacagcgccagctgagcgccgacgcggccgtgacccgcaagacctgcagcgtgtcgtccagtggttccatcaagagcgccaaggtctttagcctggacgtgcccgaccatccggccgccacagggctggctaagggcgactccaagtacatcgagaagggcagccccctcaacagcccgctggaccggctcccgctggtgccggcgggcagcggcgggggcagcggcgggggcgggggcatccaccacctggaggtgaagccggcctaccactgcagcgagcaccggcacagctttcccgccctgtactacgaggagggtgccgacagcctgagccagcgcgtgtccttcctcaagccgctgacccgctccaagcgtgactccacctactcgcagctctcccccagacactactactcagggtactcctccagccccgagtactcatccgagagcacgcacaagatctgggagcgcttccggccctacaagaagcaccaccgggaggaggtgtacatggccgccggtcacgccctgcgcaagaaggtccagttcgccaaggacgaggatctgcatgacatccttgattactggaagggggtctccgcccagcagaagctgtgaccccccccttcctccctggtgaggtcggagccagagggctgggggccttttgggggaagggtccaggcggccagggcggggagcagactcgggggccaaggcccaggagaggacgcacatgcagacccgcacgcacgcacgcacacacacacctgaccaccacccgactgtgaacaaaccaacatccgacaataacggacaggaaaacagagacacattttccttaaagtttacaaactgataccgaaaccagtcgtctttactgtgctgcccagggactctgctggggtgtgcagggccggggggctggcggggggaggaaggaagccaagagagggtgtggggtctggggggtctggggctagaaacaggtgtgggggtcaagaaagctggagtagagagggactgaagcccctctagggcagggagagggtcccttcccaagctgggagtcaagtcacctgcagatttagcattagacatcgggcaatgtctccttccactttagagagggggggaaactgaggcccagagaagggagttgacaaccccagggtcacacagcagcttagcctcaagtcccccaacttcccagcccagtgctgtcccggaaccccctgcagctctcttgtggacccctgcccgccctgtgcccaccccacatccctttccgaagctgtggtcccttggggctgagggacttgggaatcaggcaggtgctttttcttcctagaaagccacatggcagtgcccccagagtgtgcagctgtgattcagaatcctggggggcttttgacccctatgccggcacccgggagaagggagagggtcctgttgacgggaaaggagccgaggcagggcgacattccaccagcccacttcaagtgtcttccacgtggcctgggaagagtggggcgtgtggcgggcaggccagctcccaggacgtctcaggtgcaggctcccggccccagcttctctggtcctccgagacccctgcccaccgcagaagggcagcggtgcactgtgatgcctggagggctgcagggaggagctgtcatgggggacttcctgcctgtccccatggcctgtgtccccacctgcccgaccccatcgtgggatctcggctcctatctcagccgcccacccggggaaggagggctttctcacccatcccctctgggctgctcatccaggcctggccccctggccagaggggctcccatgtttccgtggcaatggccacttccctctttctgacccccccacccaacatcaaacaaagcacaaacagtgaggcccccacccgagagagggttgaggagcaggctgggttcgtggcgccccagcccctcccagccagcctctgtcaccatggtaaccctgtgcctggcagttggtgcccagagtgaccgttgggctctggggttctctgtccatgtaggcggtggcagagggtggtgagggagggccagcctggcagcagctcctggggccagctcttttgggaagcaaatctgcggtcctgagactggggtcttgaccagtcaggatgctgatgggccggagtccatcatccttcacctctgggtgggagctggcccagcggggtgtggggacgcctctactagcagctttgcccgcctagcaacatgtcgcttggctgccacccacctcagcttggggggccccggctctccccacgcccctgccagagacccccagtctagggcctgtggcccacatgggtttcctgagatttggggagtgtgactgaggggcgagggtaggcactggaatgggtccaagaccggcactgttggtgggcaggggctctgaccaggaaagctagtgccatcccctggggaccccaacgaccttcctgctgggggcagggggtgagggaggacagcagagggctaggaggctcgggctcagctgagtacctctctcacaccaactttggggttaacgaagcccagggctcactttgagggtgacatttgcaaagaaaagactgttctcctggggcgaggaggggagggggcggcatggatacgcggagcagacctcctcccccggcccccaaaacctgccccccaacccctcctcacacccccttggcacaactgagaaaagcaagcaggcagagaagccaggggtgtgaggaagcagactccctgttatatttgcatgacgattttactgtatttttctgagcaaacatctgtcgtgtatgtgccagtttgtccagactcccccgccccctctctgatgccctgctttcccacattctgtctgttgtgatctgacgagcagctcttgaaacccagggaggggtcagctctgcaaaaacagacccaaaacaggtgccaccaagacacagccctgccccacacccacctcctgtgtttctgagcattgggcccatgtgccacctcccttcctccctccctctctccactgccacctcccttgtccccagttccttcccctcctccatgccagggagggcagccccagggaagcctcctcaagggctcttgtcccggtggaagggactgtctgtccgtcccgcttgttcccgttttgtagatgaggaagtcagggctcccagacgggcctggtgaattggctggccagctggggtggaggatcagtcacactgctgagtgtaggaggccaggagcttggggcttcgtggggggcttcagggagagggtgggggctttgagaaaggaacccgtgggaagaaggagcacgcctgggctgggccccagggagggttcccagcagcaggagttaggggcctgcgcttgccatttccccatcctttctgcgtgaagatatttaggaaacctcagactctctgactgcagggacaggggcccttccaaagagcaggactctgatgatccaggaggggaactggccttgaagacccagttcatgtggttctttgtgaggcagagcggggtctaagactcgggtctctggcctcccagccaggccagagccccaactgctcagcttggggagagcccacccggaggctggcctgcatctgtgtcccacgtcctgctcaggatgagtttttcccaggcgggagggaagtattcacaaaatgttgccatccaaggtctgggtttgtgatgatgatgagcatggtggagctgggctgtggtctggggcaggccagcagggcagacaccaggaaaagagggcagggggggccacagggagggaggggagatggaggcccggtggagcgagggatgtgtgggtgccacgccctggacctctgcggggaggcctcctgccttgggccggaacaaggtcacacctgggcttgcctgcctctgttggagaatctcctctgaagctgtttctgggaagtagcacaatgggtctgctccttcctgggagggcacagcaggtgcagctaaccctctgttggagcttatggccttccagtagcaaaacacagaggtctggcatgaaggcaagaaagcctggttggtggggaaacctcgtcacgggtcccggccttgcttttccccgcggcaggaagagtctctctctgcccaccaaagaatccctcacctgggctcccctcctgaggcagtgcaggaggcctgtgggagcagcctgtgtccaggctggggagcccgtgtctgggtaggtctgggaaaagggctgtcaggggagcgaggagggtgggagtaaagagacctgcttgggaaggccaggcctggatcgtccccgggaggcagctggggcagcagcagtggggagtatcaggctggccgagagtcacccatgttctcaactggaagttggtcgcctgccccactccctcctggaaatgtaacagcggggtgaacagaagtgcagagacggaaaggagaggaaaggagacctagagctgacaaactcggttgtgacagtgctgaggccgggatggcatcaggaattaaggacaccagtgacaggtcctagcttataaggggcctaagtgcagggaagggataagacacaatgctccctagtgactggcgccttgcagaaaattaaaatagggtgatgggggaggggcaaggctggtcagggagcatcctgtgtgggatggggggacagggagccaagctgtgaatgacaagaggagccagaagggtgggtgggtgggtgggtgtgaagacgagactagagggagtggggttgcagtggctgcctgtcccccaagcaccgcctctgtcccctactaccctgcccctgcccattcctggcccagcagagccccctttccatgagtgtggatgggcggggcaagccgtcggggagcctggggaagctcagccctgaggggcttactttgcccgtggaagccagtgtgaaggttagggcagccttgcctggctggccccattgccacctctcctgtctgacaaggtggctgctccagaggtggctgagccccaggagaggggacctcctctaactctcatgctcagattccatcctgacacactccttccctgaccctgggtgccccttctaagacaaaaccagggtccatactgcttgcctccagaggcggcttcaggcctcactaaaggtcaggcagtcctgctgagcaggagggagaggaagggggtcctgtaggacgggcaggatggtctgggcctgctcctccttcctctgcccctctgccactccacactccagcacagggctgggacaggggcttggagttcctgcagtggcggccacacttccctccctccctcccttcctcaggagccgccagtccccaagttggctgtggttgggcacctggtttgggtcctgcagagctgggctcaggccctgggctctgaacctgtgaacccttgctgtgttacgaaactttccttcctctgagggccttgaaccctctccttttcttcttttgggggtgggggttaactttattttctcttccctgtatctgcctctcccttccctcaatttcctgttttaaaactgaatggcacgaaattgttttcctcaactcggagattcctgtatggagagaatcaatttctatatttgcaataaatttcttatttaaagct

SEQ ID NO: 2138 - DNA, 1005 bp, Homo sapiens
cttacagtggtccctgctggcccttggtgacgggtcgcgtcagttccgacccggacccgtacgctgctgcgctgacgtggctcctggaagcagggctggcgtagggccgccatgttgcagcaggatagtaatgatgacactgaagatgtttcactgtttgatgcggaagaggagacgactaatagaccaagaaaagccaaaatcagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggcggtggttattatgggtgtggtgctacaaggtgccaacctgtatggttacatcaggtgtaaggtgcgcagcagaaagcatttaaccagcatggctacttcatattttggaaagcagtttttaagacaaagacggtctcgccacattgcccagactggtctgaaagtcttgggctcaagagatcctcccgcttccgccttccaaagcgctgggataacaggcgtgagccgctgcccgggccatccctcgaggaagtttcatcaggactcacagaaaacactggacttccccggaagctacttgaaaaacatgacccctggccggcctatgtcacctatacctctcagacagtgaaaagactcattgagaaaagcaaaactagagaactggaatgcatgcgtgccctcgaggaaagaccctgggcatcaaggcagaataaaccttccagcgtcattcagccgaaaaggaggaagtcttccaagtcttctggcaaagctgtgttcagggacacgctgtcagaatccacgttatcaatgtggggcgcttattcggtattggccatggctcctaccatgat

SEQ ID NO: 2139 - DNA, 3458 bp, Homo sapiens
aaaagacttcagtggcagacaaaggaggagtaataagatcgctagggggcccgtgcccagcccacccacgcacaatctcagtcctcgcaatacccacaaggtaggtgctaggatcacaccctttacggacgcggcacctgcgacagggatgcgcgaggagtcagggggcctcgccggatcgaacctaagctggggaagagtatttcttgtatttttaggagaaattctcagcctcggggaagagtatttcttgatgagggaagagcgcggggaagacactcacgcacgcacaaacatgtgggcggccatggtgtgcccagcgccgtgctggcttctgggaacccccagtggacaagacggacaaggtaccggctctcaggggaagtgggagccagtcacaagcgtacctaatttcggagagtgacaagtactctgaaaaagaaagaaggtagggctggtgactggccaatttaagcgggcaggagtctgctgggggacggagaccagcctcaggtctgggttggggacagaagctgtgcctaagtgtggtgcaggatgcagttgcaaaggagcgcttccgatcgcacttgatgctcgccacgtccctgcaaagtgctcccgccccctttctgcaaatgaggaaacgggacgcgcggctcgccgggccagcccgcgtgcctgcgcagtcccctccccgagaaccatccccttgccccgcccagcgtcaggggtgcgcggccgccgagagaccccggaggcgtagccggctgcggaggcgaagaggtggcagcgcgagctgggaccagcgtctcggaggcgccgcagaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctgtggtgctgcagtcgatcctcagcctgatggacaggggcgccatggtcctgaccaccaactatgacaacctgctggaggcctttggccggcggcagaacaagcccatggagtccctggacttgaaggacaagaccaaggtccttgaatgggcaagagggcacatgaagtacggcgtcctccacattcacggcctctacacggacccctgcggggtggtgctggacccatcggggtataaagacgtcactcaagacgcagaagtcatggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagacactttttttttttgagtcagagtctcactctgtcacccaggacagagtgcagtggtacgatctcaagctcactgcagccaccaccgcctgggctcaagtgattctcctgcctcagcctcccgagtagctgggattacaggcgtccaccaccatgcccagctaatttttttatttttagtagagttggagtttcaccatgttggccaggatggtctcgaactcttgacctcaggtgatccacccgccttggcctcccaaagtgctaggattacaggcatgagccactgcgcccagcaaaataaacacattttataatttgtatgtggaaacatgttactatagaaagcattttaaaggtacgttttaaaggtccactgttaaatagtaaagaatgaatccgctagcgaaaatgtttttagggagaacagctggatcaaaagggcttctttggaattaggttgttttagtaacttctgttccaaagaaacacaggtctgatattgctaagaactgaaatcggaggagccagaggcccttttcagtccaggccaacattgtgcacggccactgtgggactgacaaccgggatagctcaagttcgagagaccaggtttcaaacattataagttccaggctttgcaagtctttattctctggggtaatatccagtctttctgttattgtctcttaaaattctcttccatggcccacattaagggagtttgcagagagtgagggaggcaaaacttgaaaagggcctgcaacactttaaaccttctcaggttcacccacatgaaacggctgtgctgagtgtgctgccggtgcccggggagcttctctgactgtgacccggcagaggcttctgtggcggtgcatgagcggccctacagtggagggttctctttggaaacaaacagccctgcttggtttcagtttgaggccacttatcttcaatgtgacatttcttgccaagccctgtgacactccccattgatgactcccataggtacagataaagttaagaacaggaaacagaagggtaggatgcatagggagggagagaagccctgaaaactttttttttctttttgaagcatggaaaacaaatcttttatgccactccagccataaataaaattttaacttcaa

SEQ ID NO: 2140 - DNA, 930 bp, Homo sapiens
agtgtacacgggggcagggccgcctgaggggagcgggcagggccaaggcacccactcctgccggtagtgccatggagtagacatctgctctctgcgtctgagccacatggtccccactgctggggcttgctgttggaaacagacagccagttgcataaacagaactgccagctggctcaccgcccagtgatggcagcagggctgttggtgtttgtgtccattccacctgctgctgtgcgggctccggggtgaagatgacttgacagtgacccgatgggcatctttgtaaggtccttgaatgggcaagagggcacatgaagtacggcgtcctccacattcacggcctctacacggacccctgcggggtggtgctggacccatcggggtataaagacgtcactcaagacgcagaagtcatggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgt

SEQ ID NO: 2141 - DNA, 521 bp, Homo sapiens
gttactgttttctgggatctgattggcttagacggtgtttggatgggagcagaacgctggagcttgctgtcctgctgaaacttctaggacctgaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctgtggtgctgcagtcgatcctcagcctgatggacag

SEQ ID NO: 2142 - DNA, 1776 bp, Homo sapiens
cggggcggggcctccggggaccgcggggccgttggtttcgggacggaacgttcacgcggctggggcgggcgcgcgggggaagggtttgcggcggcgccgctgccggctaacgcggaggggcgcctggaggcggcgtggcgtccgctctggctccgactccggctctcgctctcgcttctagcccgcgtgcctgcgcagtcccctccccgagaaccatccccttgccccgcccagcgtcaggggtgcgcggccgccgagagaccccggaggcgtagccggctgcggaggcgaagaggtggcagcgcgagctgggaccagcgtctcggaggcgccgcagaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctgtggtgctgcagtcgatcctcagcctgatggacaggggcgccatggtcctgaccaccaactatgacaacctgctggaggcctttggccggcggcagaacaagcccatggagtccctggacttgaaggacaagaccaaggtccttgaatgggcaagagggcacatgaagtacggcgtcctccacattcacggcctctacacggacccctgcggggtggtgctggacccatcggggtataaagacgtcactcaagacgcagaagtcatggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaaga

SEQ ID NO: 2143 - DNA, 1926 bp, Homo sapiens
cggtttgctggtggcatcctcagtagctgggactacaggcaataaattcttttatacgtcgctttttaaacgtattgtgcctgtgaacaaatcttcaagttatacccaagatttcaaagctcatgatggtccatagtactcgctctttaaatcaatagctgcgtatcccacagatgatttcctttgggatgatttcccagaactggaattgcagattcttcacaatgcatttttagtagagaaggggtttcaccacgttggccaggagggtctcgatctcttgacctcatgatccgcccgcctccgcctcccaaagtgccgggattacaggcgtcagccactgcgcgcggccacaaagctcccaacttttccgttaagcaccgagcttttttctagactagcagctgaggccggaaggaattctggggaacgtagtgcagacttgcagagaacgagtctcttggtcctgtgccgtagcatttccggcggaagttgctgggcgcggaaagccggcaagacctttttttccgccatcatcgctcacgcgcgcaaccctggcgacgcgtggtggcgaggctccgcctccccacgccattggccagcagctcctcgggcacgcgtatactgcgcttccgggcaatctccgccccccccccccgcatggccttctgggagttgtagttcggtcgcgagcgctgccgtcgggaggcgctccgaggttcgaggctgtgccccgcgaccccgccttcggcgctcggctcgcaggatggatcccgtacccgggacagactcggcgccgctggctggcctggcctggtcgtcggcctctgcacccccgccgcgggggttcagcgcgatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctgaccatcaagtctctggcggacattgaggaggagtataactacggcttcgtggtggagaagaccgcggctgcccgcctgccccccagcgtctcatagtccctcacccttccgcggaaagagcccccttactccacctccccgccagcctggggccaccccccctcactgcatcctggggccacccccactcactgcatcctgggaaccttcgccctgcaaggcgtttgctatcttcagccactgggcggagctgcagccctggaggagggggcgggtcgaggctgcgtggtgatggggtctccgcccccacgccctgccgggcagggctggagctggacagaagccagtgcctttaagtcatttgtgtcaaaaccctctggggtccggaggctgtgcgggtgtcctcctggcaataaacactacccggttctcgc

SEQ ID NO: 2144 - DNA, 1129 bp, Homo sapiens
gtagttcggtcgcgagcgctgccgtcgggaggcgctccgaggttcgaggctgtgccccgcgaccccgccttcggcgctcggctcgcaggatggatcccgtacccgggacagactcggcgccgctggctggcctggcctggtcgtcggcctctgcacccccgccgcgggggttcagcgcgatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctgaccatcaagtctctggcggacattgaggaggagtataactacggcttcgtggtggagaagaccgcggctgcccgcctgccccccagcgtctcatagtccctcacccttccgcggaaagagcccccttactccacctccccgccagcctggggccaccccccctcactgcatcctggggccacccccactcactgcatcctgggaaccttcgccctgcaaggcgtttgctatcttcagccactgggcggagctgcagccctggaggagggggcgggtcgaggctgcgtggtgatggggtctccgcccccacgccctgccgggcagggctggagctggacagaagccagtgcctttaagtcatttgtgtcaaaaccctctggggtccggaggctgtgcgggtgtcctcctggcaataaacactacccggttctcgc

SEQ ID NO: 2145 - DNA, 1154 bp, Homo sapiens
ccgccttcggcgctcggctcgcaggatggatcccgtacccgggacagactcggcgccgctggctggcctggcctggtcgtcggcctctgcacccccgccgcgggggttcagcgcgatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctgaccatcaagtctctggcggacattgaggaggagtataactacggcttcgtggtggagaagaccgcggctgcccgcctgccccccagcgtctcatagtccctcacccttccgcggaaagggccaccccccctcactgcatcctggggccacccccactcactgcatcctgggaaccttcgccctgcaaggcgtttgctatcttcagccactgggcggagctgcagccctggaggagggggcgggtcgaggctgcgtggtgatggggtctccgcccccacgccctgccgggcagggctggagctggacagaagccagtgcctttaagtcatttgtgtcaaaaccctctggggtccggaggctgtgcgggtgtcctcctggcaataaacactacccggttctcgcc

SEQ ID NO: 2146 - DNA, 4819 bp, Homo sapiens
cggtgaggctcgcgctcgagctgcggcgccggctcctgccgcctgggccccgggcccggcccctcccgcgccgcccgggcgatgagaagctgcttctgcgtgagacggagccgggacccgccgccgccgcagccaccgccgccgccgccccagcggggaacagaccagtccaccatgcctgaagtcaaagacctctcagaagccttgccagaaacgtcaatggatcccatcacgggagtcggggtggtggcttctcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggcacatctccctaacacttcctgccaccttccgaggcaggaacagcacccggacggactacgagtaccagcactccaatttgtatgccatatcagcaatggatggtgtgccttttatgatttcagagaagttttcttgtgttccagaaagtatgcagccctttgatctcctgggaatcaccatcaaatctctagcagaaatcgaaaaagagtacgagtacagcttccgcacagagcagagcgcagccgccaggctcccgcccagccccaccaggtgtcagcagatcccgcagtcctgaggagccagcggccacctgcggggagaccaccgccgcccagactactgacggcaggggctgctgcccccgcctcctcctgccgcctccgccagccctccctcccacactgccccagcagggctggcccggagactgggcagctaagtgggcgcatcctgtcttcagctggcctcactgacaccccggcctccctggggacattgttcataaccatgactaatctgtgtgtgctgtagtgaccagcggctcctaacgtgtctgtgtgatgaccagttgtcctccaaaaacctcactcaccacggagtcaccctgagggccccgggcagttgccctggccgcccagtgacgcccaccggctccctccgctccctcctgtcacctaccagggcagaccccactaagccgttgagtctcttcctggaagaccctgagggccggcagctttgcctaggactctccagggtcgctgatcctccccggcccagggctgccaggaacaagttcctctctgcaggatctcacagcagccctgagaagacatgggaggaagaagccagtggccctggggtggaccctgccctttggacatcccatggacttgtcacccagtcgcctggaagtcggggagcagcacccctgcccccggtggaggggttgttgctttctggggaggaggacggttgacggccctgcttggatccaccaccaggacgctgtgctcggccatggcgcgcctcccccaagggctcatctgtgcaacaaccacatgccaacaatagctccaggtgcctcagccccgtgccctgacccggggaccacagggacaccctctgagacgtgctggccccaggaggatacaggcacacgggcacccagcccctctcagagccaggcgtgtcttgacggtatctgctgacgggaacaagtcattctgaaaggtccctctgacccaggtcaccaaatttgggccagaactggcacttccgagtgcccactggtgctggcgtcctcaaagtgccgggcgccaagttcagccccaggtgcgtttgcctaggcagtggtggctgccatccctcggggcccaggccctcacccgaagggctgcctcactctgtggtgtcaggcactgggctgtgtcctgattcctcagagtatggggacctgacatctttgggtccccaagagttggctcttggatgtggaggcttgatgctgcggttgggggctgcactacctgcgtccgtggaagcctctgcctcagcggggacggcctcctgctgcaggtcctgggcagcccacagtagtgctagctgaggcccagaggaacgggaggaaagggaggcagcgccggacggcgcagctggccaagaggcgggcggggccagaaatacctcatgcccctgcaccagcccctccgtctccaggccccaggcctctttgtggacccatcttcctcctctgccaccccgatcttcactcggatacctcttgatttctgtggataagggaagcggccacttctccctccctgagacccgaggatgcccctggtgggggtggccttctcaggactcctgggtggcacagcagcaggaccttgtcatgggactgatgctgagcagggagggggctgccaggctggctgccgatgctccgttcacataagccagtgtggttctggggacctgaggagccctgtggcacccacagggggcacctatgtctgccgtggctcctcgggtggtgccctgtgtgacaaagcccaacagcaagggtgactcctggcaggtgggggcagcaggagggcagagggcagagctctggccacttctgcccacttcattagggtttgtgaactttgtccttcacctcttttcgtgccctggttgtgagattgcctctaacaggtaatgccaggggcccttcactccgcccccatgactgggaagaggcctgtggcagcgccgctggaccctaggaggctcagaggcagtggtgtgggagccctgtctgcaaggacgcagaataagcagtgagggcggctgcaggagaggaaggggctcccacagcccccactgatgccgctgcaggcccctgtcgagctggggtcccagccaggtgcccccgcatgccctcctgcagttgctggatggatagggacaccaggaagaggacaaactgcatggactcaagcgagctggagccatcttctccatagcattacggacttagcataagagtaaatgactgtgaacgttgtagtaaacggcagcttaagataagtaagcagagacagtgttaaggacgagttggtgtctgtggtagcttttaggctgctcctaacccaccatttattgccttctgagaggtgggtgaggacaagcatgtgcctgtgtgtgtgtgtgtgtgtgtgtgtatatgtgtgtgtgtgcacgcacatgcgtgtgtataagcccacctgagtggggctcgtgcaggagaactgaggcatgaaactctggctcaaacctaggaattgagagcgtttctgtcttttgggagagtacttttctccacgagccctctggccactgtgggagggaaggacaagggttcccttggaaatgtgaagggtcttggcctcatccctcaggtccccccacagcacttcccactactgcttctgtccctgctggcagcctctgtccctccagaacggctaaccagagcacactgtccccaccgcctcccctttctctctggaaagttgaagtatctccaaaggccttggaaatggcacaaaggtgataaggagcaggtgctttgctgcagtctcccttgcaaatgtataattaaggcctttcttcccaccccaagtccaagaacaaatgccagccacgtcctccgccacttggagagatgagaacccagtggggtcacgtaaaggaattgcaggtcggtgagaggacaagagggactcccatgttctaagcacctgttcctggccaggctctaggccaggctctctaagcacatttctcctttcattccccctaaaaacagagtgacctggaagtagatgttctttgctccttgtcagagttgaagaggctgacttggcccactgctaagcggcagaggcagggccagccatcctgtcgcaagcccgtgctggggctgccctttctgtttccagtccagttacggacttcccggccgccactgggccctgccggtcaccaggccactgtgcagtgggcgcagagcatggtcaggagtggcctgcccgtactcctccacccagatgagggccctccagagcctgcaggcatctgtggggaatcccagcctgcaggttcttggagaagcaggtgaacctaaggatgaaagcaaaggagggccttgaggaagcagcccccaggcctggcagccacgcagcggctgagctcatgaacttggttcgcagcctgccttgcccctggaggccacgccaggcgctcacccctgagcccacagcccctgcttgggctgcctggcaccctcagggtggcccggcctcctcctgccactctgagcacatgtccgggggttgccaccagagacggctttgttctcccagctaaggccgtggagctgctgtgtgactgtgtcaggcctggacaaggaagacccttagggatgacgtccccgctgcatatttattcaaggtgactcttgtacttggcaagggaagtccactgtgtgattgtctgtattcttaatataatttgttaaataaacgtttgttttaacctctttc

SEQ ID NO: 2147 - DNA, 770 bp, Homo sapiens
gtgatttgactctggctggtcaccaggtaatctgtccaaagttcagaaggtgtcaggatgctatcctgaggctccacagtgacagcctctcagtctgtgcactgtcccccacgggtggccccaaagccagctgcccatttaactgggcacagcatggacactggcctcagctctcagccttctgaggaggaccagtccaccatgcctgaagtcaaagacctctcagaagccttgccagaaacgtcaatggatcccatcacgggagtcggggtggtggcttctcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccag

SEQ ID NO: 2148 - DNA, 1051 bp, Homo sapiens
aatctgtccaaagttcagaaggtgtcaggatgctatcctgaggctccacagtgacagcctctcagtctgtgcactgtcccccacgggtggccccaaagccagctgcccatttaactgggcacagcatggacactggcctcagctctcagccttctgaggaggaccagtccaccatgcctgaagtcaaagacctctcagaagccttgccagaaacgtcaatggatcccatcacgggagtcggggtggtggcttctcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggcacatctccctaacacttcctgccaccttccgaggcaggaacagcacccggacggactacgagtaccagcactccaatttgtatgccatatcagcaatggatggtgtgccttttatgatttcagagaagttttcttgtgttccagaaagtatgcagccctttgatctcctgggaatcaccatcaaatctctagcagaaatcgaaaaagagtacgagtacagcttccgcacagagcagagcgcagccgccaggctcccgcccagccccaccaggtgtcagcagatcccgcagtcctgaggagccagcgg

SEQ ID NO: 2149 - DNA, 876 bp, Homo sapiens
aagatggaggcaccagctcatgggctggagccctgtgggtggggggcctgctggctggtgtgctacacagtggggcgacgagcagggagctggctcagatcgtgggctggtccaccctggcgctttccagagacaaagccctcagtgtccagtgttcaggggaggcggctggaagcaagaaggagggttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggtgaggccttgtcggggtgtcttgcgttgtcctgtggtcttaggtccctgcacaacattttagaacaccaccacttagtgtctgctgaaatactgcaaagtacagctgaataattgtagaagcaatatatctttagaggagatttttaaaaatccacttggaaatctttgcattacatgaatgcaaaggccattctatagtctattttgtgcgtgttctgcaggcttctaaa

SEQ ID NO: 2150 - DNA, 2679 bp, Homo sapiens
cggtgaggctcgcgctcgagctgcggcgccggctcctgccgcctgggccccgggcccggcccctcccgcgccgcccgggcgatgagaagctgcttctgcgtgagacggagccgggacccgccgccgccgcagccaccgccgccgccgccccagcggggaacagaccagtccaccatgcctgaagtcaaagacctctcagaagccttgccagaaacgtcaatggatcccatcacgggagtcggggtggtggcttctcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggtgaggccttgtcggggtgtcttgcgttgtcctgtggtcttaggtccctgcacaacattttagaacaccaccacttagtgtctgctgaaatactgcaaagtacagctgaataattgtagaagcaatatatctttagaggagatttttaaaaatccacttggaaatctttgcattacatgaatgcaaaggccattctatagtctattttgtgcgtgttctgcaggcttctaaaattgcagattatgcaacttaaaattggctccctattcaaaagagctgctagctacacacagacacgtgctgtatagccatggggttgggatcactggccttaaggtcaaattccttctctgtcttggccagcaactcatttgaaacccaggagggtaggtgagttcttatattcttcattttcatataatttctttttccaatgagctataaagtaagaaatgggtagtttgggtatgagagaatagtgaggagtttttcaggaaatgctagttttaacaattgtctccgcaaagaaacttgggtgagccaactgtttgctctgcaactgatttcagtcataacagaggtagtaacagtctctacactttctgcaaaaagaatcctgtcaaataaaaatcctgtgcatcactaggagtaaactaagggcaaggaacaaacagcactgatggattaagcttgagaaagggattgcaaaagtaaataaaacaagaacggtgaggcagcaacacttagggattgacataacgtaaatgagaatggatctccaagcttccacgtgggtgaatagagatgaacaaaatctgtcaggaaccggacagaagagtcaccagtaggtcttcctgggccatccacaatacagcctgccctccgggacataccaccagctctctgtactctgttcctctgtgccaagcctccgtctcacttggaagaatgtgctgtaatgaggctccaaagccctgaggactctgtcctctgggacatccccctataaagacaatctggtccttctcatgacagtttcacaaaccaagagtggtatttaaacttaactacccctggaattgcctgaaactttagaagtagttttcagtttcatttggcataaaaagataggaatctctaataagcctcccagagttgcagggtgaacagttgagtctctgttgggttcaagagtgtgaggttcgcactgcccatcagcacttgttcctcacttctgagccagagcgctgtcagctccgccctggagggcactgctgagggtcactgtctcctgtgctcaaggctatatcaggtgtgtcacctgtgctggggagtcagctaagtccatcacctgtgtgtcggggtcctccatcacctgtgctgaggcccatcacttgtacttggagcagctcaagtgtgggctccttgcagaggctggaaagcccccacaggagcagttgccctgaagttgttacagctgctccctgctgacatcatgtggtctagaagggcccagaaatgggcaccacctcaggcaggttttgactttctgtggttaaagaaagaacaccagttctctcagataaagcagagagagctctcagaagcctgctggtgactgtgagagcaaagtcacttgcacctgaagcaagacagccgagaacaccgagccaccggcagcctggtgggtttggagggtagtgcgtcagaaccagatgtttataaggcttatgtattttatcacctctgctgtacagtttatggtttacaatggctgcaaggaaatcggatcagttttgttttacttgccaaataaaacaaatgtcaaaatagtcaatataaaatgtattctaatttggctgagttaagtcagccaatatgcaacaggataattgaatgttcattagtgcttccaagtaaaagccatttgtctgtc

SEQ ID NO: 2151 - DNA, 6928 bp, Homo sapiens
cccacggatcatcagaaggcgcggacctggaggaggcgccccagaaggcgacgcctcttgcctcctgtctctcgcctctcgaaggaagtttgctcttaatttcagagccgggttcgccgtcggatcaacctccaggagctagcagcgggcgcggaccgggcagtttccgcgctcagcacaggcagctcgcggtcatgggcggctcagcctccagccagctggacgagggcaagtgcgcttacatccgagggaaaactgaggctgccatcaaaaacttcagtccctactacagtcgtcagtactctgtggctttctgcaatcacgtgcgcactgaagtagaacagcaaagagatttaacgtcacagtttttgaagaccaagccaccattggcgcctggaactattttgtatgaagcagagctatcacaattttctgaagacataaagaagtggaaggagagatacgttgtagttaaaaatgattatgctgtggagagctatgagaataaagaggcctatcagagaggagctgctcctaaatgtcgaattcttccagccggtggcaaggtgttaacctcagaagatgaatataatctgttgtctgacaggcatttcccagaccctcttgcctccagtgagaaggagaacactcagccctttgtggtcctgcccaaggaattcccagtgtacctgtggcagcccttcttcagacacggctacttctgcttccacgaggctgctgaccagaagaggtttagtgccctcctgagtgactgcgtcaggcatctcaatcatgattacatgaagcagatgacatttgaagcccaagcctttttagaagctgtgcaattcttccgacaggagaagggtcactatggttcctgggaaatgatcactggggatgaaatccagatcctgagtaacctggtgatggaggagctcctgcccactcttcagacagacctgctgcctaagatgaaggggaagaagaatgacagaaagaggacgtggcttggtctcctcgaggaggcctacaccctggttcagcatcaagtttcagaaggattaagtgccttgaaggaggaatgcagagctctgacaaagggcctggaaggaacgatccgttctgacatggatcagattgtgaactcaaagaactatttaattggaaagatcaaagcgatggtggcccagccggcggagaaaagctgcttggagagtgtgcagccattcctggcatccatcctggaggagctcatgggaccagtgagctcgggattcagtgaagtacgtgtactctttgagaaagaggtgaatgaagtcagccagaacttccagaccaccaaagacagtgtccagctaaaggagcatctagaccggcttatgaatcttccgctgcattccgtgaagatggaaccttgttatactaaagtcaacctgcttcacgagcgcctgcaggatctcaagagccgcttcagattcccccacattgatctggtggttcagaggacacagaactacatgcaggagctaatggagaatgcagtgttcacttttgagcagttgctttccccacatctccaaggagaggcctccaaaactgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaagtgataaaggaagctgctatcttgaagaaacacaacttatttgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgggccaagcccacccccagatgggactgagcaggtgattatttcaagagtggatgaccccgtggtgaatcctgtggcaacagaggacacagcaggactcccgggcacatgctcatcagagctggagtttggagggacccttgaggatgaagaacccgcccaggaagagccagaacccatcactgcctcgggttctttgaaggcgctcagaaagttgctgacagcgtccgtggaagtaccagtggactctgctccagtgatggaagaagatacgaatggggagagccacgttccccaagaaaatgaagaagaagaggaaaaagagcccagtcaggcagctgccatccaccccgacaactgtgaagaaagtgaagtcagcgagagggaggcccaacctccctgtcccgaggcccatggggaggagttggggggatttccagaggtaggcagcccagcctctccgccagccagtggagggctcaccgaggagcccctggggcccatggagggggagctcccaggagaggcctgcacactcactgcccatgaaggaagagggggcaagtgtaccgaggaaggggatgcctcacagcaagagggctgcaccttaggttctgaccccatctgcctcagtgagagccaggtttctgaggaacaagaagagatgggagggcaaagcagcgcggcccaggccacggccagtgtgaatgcagaggagatcaaggtagcccgtattcatgagtgtcagtgggtggtggaggatgctccaaacccggatgtcctgctgtcacacaaagatgacgtgaaggagggagaaggtggtcaggagagtttcccagagctgccctcagaggagtgaaagggacaatttggctgaagtctttctctgaaaaaagccaaagggttataggggtacacttaggggttgcatgcaagctgttaccaaaaaatttttaagtattttcttaatttgaataataaaaccagaggaaatgcatacagggcatgagcaactgaggcaaacctttgtggacatgaattgttctacgatgaatttttgctttagtattttaataagaattacaaagacaatggcatacttggggtgagagggagctgaggatgtctgaggagggaatagtattgcagggaagactgagaaaacagtaggatgacagttttgagtatactctgcacttttcaattgtgcaatcttcttgtgcactttaaggctttttaattttgtttgagaatgcaaatgtatactgtaagtctacctttactatctactatgcctacttcaccatctcttaaggactcggcatttgtccacagtcagactgcaagagagggtaggtcatgaacagtcacccgtgctggctgtagcccccacagaggcaatcatgcccaatagattcaagagaagctaagcggaaatggagggtggaaggtgtgatctgtgggactgtctgggcctgttactcatcctgctatcaatttcttattaattaatcttgatgattcttattaattaatcacatttgcaggaaattcagatgaggcaagaaaattttattggcctgggtaagactgaaagcattccaaattaggcttagactgtgcaaagggcttagctaagttatcgagcttaaaacccgtcaattaaacaaacattatttgaacagttactgcatgccacgcactgtgttgggcttagtaataaaaaaaagaaaagataagtgcttgttctagcataaattaaaaggtccaagggaatttaatctggaagagaacatatgccaatttttaaactatgacagcttttttttttctctttccattcaaatagtcctggttcattcccagaagggcacaaaatgaatgaataaataaataaatgaataaagacaaaagccaaggtgtatgctctcaagttccaaagatgttatcaaaagctgaaatcatttgtttggtcattcagcaagctaattgagtctctgttatataccaagcactggggataccatggcgaaaaacaactttgttccttcctcctagaacttacattttaatggaaatagacaaaacacatcttcttaacggatggtgacctataaccattaatgttgaaaatggaagagacttgcttccaaaagattaaaaggagttgttcttttctccttcagaaaaataccagatcatttcctaaaatctccagtcccaagtattacatcgtggtttccctccccgactttttattttattttattctatttttttgagatggagtctcactctgtcgccaaggctggagtgcagtggtgtgatctcggctcactgcaacctccgcctcctgggttcaggagattctcctctgtcagcgtcccaagtagctggaattacagccatgcggcaccattcccggctaatttttgtatttttggtagagatgggttttcaccatgttggccaggctggtctcaaactcctgatttcaagcgatccacccacctcgacttcccaaagtgctgggattacagcgtgagctacctggcccctccccaaattttaacatcagatctcaacatatttgttgagaacttgtttagatcatcactatcgagtaaatttatgtcagttctttagagcatttgcttcacacacagttcaaccatttaaccagaaattaaaatatcacccttttcagccctcccatgaagaatttctaggtcataaacatgaataatactcagtatatgtataatatcatatttaattgttgcaacttttcttggcgtgtttaaatcctcatgtctttgagggatcccaccacaggtgaaggaagtaaagaccacttctcccccagtctctgctttctgcagtgctcactcatatcctggcatttagcatggtgtgttgaaattaggtttacttcttgtctctccaagtggctcctctcttaaaagacagaaactagggtttagtcatcatttgtgcttcctgctagaaacccacagccttgaataatggcttcctgcctccttgagtcactttaatatccctggtgcataggacctggcatgcgtcaggctgctcgggaaatgtgggaactggacacccagaacactgctgtgctggggctatttggggcctgctgtcaggcagaaagacgttttgaattgggctttctgcccttgttgagttttctcttaagtaaagtccaaagtccaaggggcagatggccagatgcactgcccagtaaggcaggaagccaaagaggcagtgcccagccccacaaaggctgcccgactccctgggacagtagtgtggagtcccagcccaggctgacctcacaccggagcttcctagcttcctttctttgctcaatgcagggcttcttgcaccccctggaaagctaagagatttttttcaaccctaaaagagagtacctttcactgcattggatggatgaacatcagtgccctaactttatccatcatgtaggtcagggaggactgggcactatttggcaggatgtactccagaatataatcaaagaattttctgtacatatttcactaaagacaagtttttgggctggatgtggtagcttacacctataatcccagcactttgggaggctgaggtgagagggtcacttgagcccaggagttctagacaagcctgggaaacatagcaagatctcatccttacaaaaaataataatggtgtgtgcctgcagtcctagctacttgggtggttgaggcaggaggattgtttgagcgagggaagttgaggctgcagtgaactatgattttaccactgcactccagcttgggcaacaaaatgagaccctgtctcaaaaaaaaaaaaaaagttttctagaataagcaggatgattgtttaatttgaagatggaacaggaaactagagtgcatttaaaatactctgtcttcattttaacatgttgaatggaataactgcatatcaccatgagtttgttttgcttttcatacagacttgtatgtgtcatttgagtggtttccagattggagcgaggttattctgatctaaatgaacagcatttttttccttagcctctgtttgccactctgggtatctctcctatgggcaaagccattagaaatgcataaaacctcgagacatggtttttggcaaaaactccatgactttaaactagctcttttactactgacctttcacagagaaaaaatatttcccttgaaaaaaactgggcttgtcattttttcccttgtagctttaagcagagacataagtgccttgcattacacatagtaaactttctttaaaaaaaaaaaaaaaagattttggagactaccagggtaagattccaacttgtccaaaagctttctggccttacatattttattataaaaattctcaagtctggtaatcttctatgtcagagctagtgatttcaaaaggtttcacaattccccaagacaaaagtgattttcgttcattataataaggttaagtgatatgtgattcatagcaattttgatgtgaagaagggaaggacatcattgacttaataatagtatcagtcggtgcaacagttggcaacatgtgccttcacactttaccataaagagacgggtttgagggtttgccttctaaagtctgcaacttcaagaaaaaaaatcgacactgtggattgactttcccggtcactatataaagcaaataaacttaaaacactttgtaaccatgtatttactctgccaggtgcctatattccaataaaatgttcatccttgaaga

SEQ ID NO: 2152 - DNA, 602 bp, Homo sapiens
tgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaaggtgcctatattccaataaaatgttcatccttgaagagctgaccagatgtcatttatttggaaggaggctggtttcatcttttaagcagatgtcacatttgaattgtgaggtacagccctctgaaacgaaaaggcgagtcattcttgctgtatcatggaccttttacttttctgttgtcacgaaggaatctgcagggaaaccacttaatgtcaggtgtaattatgctttgataatgcatatgcttacgtctccaggaattggatcacattcataatacagcagtgggcaattattcttgatgtaattgaactgctgttcaaacttaaatttattttcaatggg

SEQ ID NO: 2153 - DNA, 4618 bp, Homo sapiens
agcgctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctctttggggaagaaaagcccagaactgagcagatggcctcctttatgagttcatgtcctccgccttcagctggaggtaccatatggcgatgctacctgtctttctgctggaggtaccatatggtaatgctgcctggctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatgactgcaacatgtcctatctttaatctattttcttattaagcttggacattgacaatagaaccagaagcttgtagctggatcaaaatattctccataggcctggagtttcatgagggtctattcttttgttgttgttgttttggttttttgttttttgtgggtttttttttttttttttttgagacggagtcttgttctgttgcccaggctggagtgcaatggtgcagtcttggttcactgcaacctctgcctcccaggttcaaacaattctcctgcctcagccgtccaagtagctgggattacaggtgcatgccacgatgcctggctattttttgtatttttagtagaggtggggtttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctccaaaacaagaaa

SEQ ID NO: 2154 - DNA, 2139 bp, Homo sapiens
tctgagatggatgcatgagcctgtctcacccactcactgctgaggtgcctgtctctccctaaggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctag

SEQ ID NO: 2155 - DNA, 3807 bp, Homo sapiens
tgtggtgcgaagccacctcccccgccgaatcgcgcatctgcgcagttgctgttattgtgacttgtcgggccacggccccggatgttgtggctgccgcggggagatggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcctctgctgagtcgggtgcaggcagccctggtgtgggagcggccagctaggagcgctctgtggtgcctggggctgaacgcggctttctggttttttgccctgacatctcttcgtcttgtgtttttacttgcatttggcttgatgatcattgtgtgtattgatcaatggaagaacaaaatctggcctgaaataaaagtgccaagacccgacgcattagacaatgagagctggggctttgtgcaccctcggttgctcagcgtgcccgagctctgccaccatgtagctgaagtctgggttagtgggaccattttcataaggaatgttttgcttttcaaaaagcaaaacccaggcaagttctgcttgctgagctgtgggatactgacctttttggctgtcttgggccgctacgtccctgggcttctgctgtcctacttgatgcttgtcactgtcatgatgtggccccttgctgtgtaccaccgactgtgggatcgagcatatgtgcggctgaagccagctctgcagcggctagacttcagtgtccgtggctacatgatgtccaagcagagagagagacaattacgccgcagagctctccacccagaacgagccatggacaaccacagtgacagcgaagaggagcttgctgccttctgtcctcagctggacgattctactgttgccagggaattggccatcacagactctgagcactcagacgctgaagtctcctgtacagacaatggcacattcaatctttcaaggggccaaacacctctaacggaaggctctgaagacctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgaacttctggaccagtcggagctgagtcagctggaccctgccagttctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctcagtcactgaagtgagagtgtgctcccccaagggaggcttctctccatcaggatggtactttgggggaacaaaatagtcagggatattggttcccctttgaggaggtgctgctgtttgcttttaggtatgagtgctcaggggccctcactgaaagagcccatgcctgccttcctcctttcatcgcctctctagagcccccaaagtcaggcagcagctggagtagttacattgtcatcatctttttttttgagacagtttcgctctgttgcccaggctggagtgcagtggtgtgatcttggctttctgcaacgtctgccttccaggttgaagaggttctcctgcctcagcctccttagtagtgggattacaggtgcccgctactatgcccggctaatttttcttttggtatttttagtagaaatggggtttcaccatgttggccaggctggtctcaaactcctgacctcaagtgagctgactgccttggcctcccagagtgctgggattagtcgtcatcttttgttaaaccaggatttgatttttttcttttcttttcttttcttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttaaagcaaacttgtcctttggttttgcagaacaggcctgctccctctcatctagcccatcatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatcttcggtttctgataacccctgggtccatctggccatcagcctcagcagtgagcaaagcaataccatactcatttctatgttcctgttccttcctctgctcctcctttggagaagcaataattcatgggggatgatacagtagcactttacaaatggctccatgtcattcatcccaggggccataatctcttgcaccacctattcttacttcctgttcagctcctttacagcttttattttcaactgcttcccaacttggtggggcctcctttaaggatgagccaatagtaagaatgtggctgtaatcagcagagacccctctgaggggtatctgttctgcagcccctagtgaaatcatgtgatgtgagacagaaacctaaacatggtacttgattctaaacctgtgccagtctatagcctctgcctccccaagcagagctcaagccaaacgcttctgtcctctttccttctgcattaaccctttgctgatcctcaggggccactcccccaacacccctgtacttgggtgagggatgttggacagagcctgttttcatgtactgcaggtgggggtgtgctgacatgtttgctcttggttgatggagaaggtacagaggccagggagtgaaaatggttgacagaagagggaagagttaggtgtctcatagtcactcatagtggggtggtcaggggtaatggcatctccccactttaggcttctcaaacagacttttgacacctctcaagttcagagctctgatgtggaaagacaggaggtgtggggaaggagggggatttcgtgtgtttgcatgagtgtgcgcttcaggccttgggagttggcaagagggagggaaggaaggagagcaaaatcttcggaaggtgtttcttgtacctgagggatcctgccctgaatctccatagtctccactgtgaactgaggaggggaggggtgtgctggggaataaatcttgtatgagaacaatcttt

SEQ ID NO: 2156 - DNA, 1610 bp, Homo sapiens
gtcgggccacggccccggatgttgtggctgccgcggggagatggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcctctgctgagtcgggtgcaggcagccctggtgtgggagcggccagctaggagcgctctgtggtgcctggggctgaacgcggctttctggttttttgccctgacatctcttcgtcttgtgtttttacttgcatttggcttgatgatcattgtgtgtattgatcaatggaagaacaaaatctggcctgaaataaaagctggggctttgtgcaccctcggttgctcagcgtgcccgagctctgccaccatgtagctgaagtctgggttagtgggaccattttcataaggaatgttttgcttttcaaaaagcaaaacccaggcaagttctgcttgctgagctgtgggatactgacctttttggctgtcttgggccgctacgtccctgggcttctgctgtcctacttgatgcttgtcactgtcatgatgtggccccttgctgtgtaccaccgactgtgggatcgagcatatgtgcggctgaagccagctctgcagcggctagacttcagtgtccgtggctacatgatgtccaagcagagagagagacaattacgccgcagagctctccacccagaacgagccatggacaaccacagtgacagcgaagaggagcttgctgccttctgtcctcagctggacgattctactgttgccagggaattggccatcacagactctgagcactcagacgctgaagtctcctgtacagacaatggcacattcaatctttcaaggggccaaacacctctaacggaaggctctgaagacctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgaacttctggaccagtcggagctgagtcagctggaccctgccagttctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctca

SEQ ID NO: 2157 - DNA, 5042 bp, Homo sapiens
ctgtgatggcgatgtgagggggcccggggcgggatggtgctgacccgggtcgggccgtcttcttgcagctggacaacgagctcctccgttcgacaggcgggggaagaggccgagccgggcgagagggttgaagatcaactggattatgtatttggttctggaatctcaaagcagtccacaaacaaattcttccttatgttgtctgtgtcagggggaacggtgtatttttaacaacgggaatcagtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagaggatggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttgg

SEQ ID NO: 2158 - DNA, 5676 bp, Homo sapiens
ggtgagagaggccgggggcggggccgtgcggccggggacctgttgatcgcaggtatagccggctggcccgggctccctcgggactggggcgactgcgcatgctcgctggccgcgctgggccagtagccgagccgcggtgacgaaccggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggttgaagatcaactggattatgtatttggttctggaatctcaaagcagtccacaaacaaattcttccttatgttgtctgtgtcagggggaacggtgtatttttaacaacgggaatcagtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggccaaggccaacatgcagctcctatatgagcgtcttctcagaagaaaacagctacgaacacagaaagacaaccatctagaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagaggatggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggaggaacagct

SEQ ID NO: 2159 - DNA, 6415 bp, Homo sapiens
gctggaggggcagttgaagctcctgaagggcggggcacggagcttgaaggggcggggcctagcctcagagaggggagggaagaggcgggaggaggaggtgagagaggccgggggcggggccgtgcggccggggacctgttgatcgcaggtatagccggctggcccgggctccctcgggactggggcgactgcgcatgctcgctggccgcgctgggccagtagccgagccgcggtgacgaaccggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggttgaagatcaactggattatgtatttggttctggaatctcaaagcagtccacaaacaaattcttccttatgttgtctgtgtcagggggaacggtgtatttttaacaacgggaatcagtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaacacaaaaaaattaataaaacagaactctaaggattctgtggttttggtaggctacaaatgtttgaaaagtacagcatcaaatgatctcattaaatgctttgaaggcaatccttcacatagtcagaaggaaggtctggatcccacaatatgtggatataattttgacccaaagacctacatgagacagacaagtcaaaaggaagctagctgtttgccaactaatacagagagaactgaacaaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagaggatggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggaggaacagctacaa

SEQ ID NO: 2160 - DNA, 5282 bp, Homo sapiens
tgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggggaacggtgtatttttaacaacgggaatcagtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggccaaggccaacatgcagctcctatatgagcgtcttctcagaagaaaacagctacgaacacagaaagacaaccatctagaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagaggatggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggtt

SEQ ID NO: 2161 - DNA, 641 bp, Homo sapiens
ggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggttgaagatcaactggattatgtatttggttctggaatctcaaagcagtccacaaacaaattcttccttatgttgtctgtgtcaggctggagtgcagtggtgtgatctcagctcactgcaacctcctcctcaagggttcaagcgattctcctgcctcagcttcctgagtagctgggattacaggcccgtgccatcacacccagggggaacggtgtatttttaacaacgggaatcagtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatg

SEQ ID NO: 2162 - DNA, 546 bp, Homo sapiens
gcgctgggccagtagccgagccgcggtgacgaaccggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggttgaagatcaactggattatgtatttggttctggaatctcaaagcagtccacaaacaaattcttccttatgttgtctgtgtcagattcgagtatttgccaaatttctatgaagaactgcttcaagaattgggaagggtctgagattttaccccacttgcaagctgacaagttagtctgccacggtgccatggatgttggcaggacatgagagtcatggatcaaggtgctgttatcagaatagtcttctgggtataaattaaaaatgactgaagttcaagcaatggtagaattctctgtggagctaaacaagttctacaatgtggatttgtttcagagaggtttttaccagattcgt

SEQ ID NO: 2163 - DNA, 1926 bp, Homo sapiens
ggccgtgcggccggggacctgttgatcgcaggtatagccggctggcccgggctccctcgggactggggcgactgcgcatgctcgctggccgcgctgggccagtagccgagccgcggtgacgaaccggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggggaacggtgtatttttaacaacgggaatcagtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaac

SEQ ID NO: 2164 - DNA, 558 bp, Homo sapiens
agaggtgctttctctctggacagttttatgaatacataaggaggttctgtccccactcccttcgcaaccgcatcttattggtaatgagccaaaaagatcatgtctgaaatacaaggaacggttgagttttcggtagagctacataaattttataatgtggatctctttcagagagggtattaccagatccgagtgaccttgaaggtgtcttcaaggatcccccacagactgagtgcctccatcgctgggcagacagagagcagcagcctgcattcagcctgtgtccatgacagcaccgtgcacagccgggtctttcagatcttataccggaatgaagaggtacccataaatgatgctgtggtcttccgagttcatttactcttgggtggtgaaaggatggaagacgcactgagtgaagtagattttcaactcaaggtggatctgcactttacggacagtgaacagcagttgagggatgtggctggggcaccgatggtcagcagccgaacgcttggcctgcacttccacccccggaatggtctgcaccaccaggtcccg

SEQ ID NO: 2165 - DNA, 6962 bp, Homo sapiens
aacaccagctcgcaggtgctgcggactccccagtccgcccgccgccgccgccgccgcaactgttggcggccagagacggcgaaagaggagagagagggacccaggagcgcggcccccgggggagagagaggggagccctgcagtggagacaggtaatgagccaaaaagatcatgtctgaaatacaaggaacggttgagttttcggtagagctacataaattttataatgtggatctctttcagagagggtattaccagatccgagtgaccttgaaggtgtcttcaaggatcccccacagactgagtgcctccatcgctgggcagacagagagcagcagcctgcattcagcctgtgtccatgacagcaccgtgcacagccgggtctttcagatcttataccggaatgaagaggtacccataaatgatgctgtggtcttccgagttcatttactcttgggtggtgaaaggatggaagacgcactgagtgaagtagattttcaactcaaggtggatctgcactttacggacagtgaacagcagttgagggatgtggctggggcaccgatggtcagcagccgaacgcttggcctgcacttccacccccggaatggtctgcaccaccaggtcccggtcatgttcgactatttccacctgtctgtgatctcggtgaccgtccatgctgccctggtggctctgcagcagccattgatcagttttactcgtccaggaagaggctcctggcttggtaaaggtggcccagacaccggacaagaacagtctatcatttctctggaaaacttggtctttggagctgggtactgcaagccgacttcctcagagggaagcttctacatcacctctgagaactgcatgcagcacgcacacaagtggcaccgagacctgtgcctgttgctcctccacgcttaccggggtctccgtctccacttcctggtgatcatgcgggacatcccagagctgccacacacggagctggaggcccttgctgttgaagaaacactttctcagctgtgctcagagctacagatgttgaacaatccagagaagatcgctgagcagataagcaaggatctggcctggctcacgtcccacatgatgactctgtggacccagttcctggacacagtcactctgcactcccaagtgaccacttatctcacccaggaacaccacaccctgagggtccgaaggttttctgaggccttcttttacatggagcaccaaaaacttgcagtcctgacatttcaggagaatctgatacagacgcacagccagctgtccctggatatccggaactcggagtacctcactagcatgcccccgctgcctgcagagtgcctggacatcgacggcgattggaacaccctgccggtgatctttgaggacagatacgtggactgccctgcgacagggcataacttgagtgtttatcctaattttgatgttccagtgacaagtcctacaataatgaatctgaaagacaaggaagataactgtatggtaaatagcaatttatcttttagggaagaccttgtcttgtctaccataaaaccatcccaaatggattctgatgaagaagttataaggtgtccagagccaggtgagaatgtggccacacaaaatcatatggacatgtgctctgaatctcaggtgtatatatcaattggtgaatttcaaaacaaagcaggtgtgcctgaagatgaatgttggactggccaaacatctgatgctgggacatatccagtggcagatgtggatacttctagaaggagtccaggtccagaggatggacaggccccagtgctgacctacattgacgtaaaatctagcaataagaacccctccagagctgaacccctggtggccttcaatgctcagcatgagagtaggagctctagagataagtatggattagacaggactgggctaagcaaagtggtagtaggtggaagccaccaaaatgccatctcttcagacaaaacaactctccatgaattaagtactctaggaaagggaatagatcaagaggggaagatggtgctgctaagcttgaaactcaccccctctgagccctgtgatccactaagttctaccctgagggagcccttagatattaggtcttccctaaaggactctcacacagaagagcaggaggaactctcagtgctatccggggtcatcaagagatcttcatccatcatatctgattcaggcattgagagtgagccaagctccgtcgcctggtcagaggcccgaagcagggctctggagttgcccagtgatcgggaagtcttgcacccgtttgttcgaagacatgccctccaccggaactccctagagggtggacacacagaaagtaacacaagtttgccaagcggcatccaggcttctctcacctccattagctctttaccttttgaggaggatgagcgggaggtggcactcactaagttaaccaagtctgtatctgctccccacatcagtagcccagaggaggctgctgaagatgcggacaccaagcagcaagatggaggttttgctgaaccttcagatatgcacagcaagagccaaggttccccaggatcttgctctcaactttgtggtgactctggaacagatgctggagcagaccatcccctggtggagatagttttagatgctgacaaccagcagggccccggatacatagacatccccaaagggaaagggaagcagtttgatgctcaaggacactgtcttcctgatggcaggactgagaacactccaggtgttgaaaccaaaggtcttaatttaaaaataccacgcgtcatagcacttgaaaaccccaggaccagatctcttcatagagcacttgaggaaaccccaaagggcatgcctaaagacttgaatgtgggtcagcaagctctttccaacagtggcatctcagaggttgagggtctctctcaacatcaggtgcctgaattgagctgtacgtcagctgctgatgccatcaacaggaactcaacaggccagcaaagccaaagcggttcaccttgcattatggatgacacagcatttaatagaggagtgaatgccttcccggaggctaaacataaagcaggcactgtgtgccccactgtgacccattccgttcattcccaggttttgaaaaaccaagagctgaaggcaggcacttccatcatggggtcccatctgacttctgcagagacctttactctggacagcctgaaggctgtggaggttgtgaacttatctgtgtcttgcactgccacctgtctccctttctcatctgtgcccaaggagacccctgccagggctggattctcttccaaacagaccctgtttcccatcacccatcagcctttgggatcctttggagttgtttctacccattccagcacgttggatgaggaagtcagtgagaggatgtttagtttttatcaggccaaagaaaaatttaaaaaagaactgaagattgaaggatttctgtacagtgacttaactgtactagcttctgatataccatatttcccaccagaggaagaggaagaaaatttggaagatggaattcacctggttgtctgtgtccatggcctggatgggaacagtgcagacctccggctggtaaagactttcatagaactggggctccctggaggaaaactggacttcctaatgtctgaaaagaatcagatggacacatttgcagattttgatactatgacggatcggttattggatgaaatcattcaacacattcagttgtacaacctctccatatcccgaattagcttcattggccattctcttggcaacatcatcatccgatcggtcctcacacggccccggttccggtattacctcaacaaactccacacgttcctgtcactctctgggcctcacctgggaaccctgtacaacaacagcaccctggttagtacaggcttatggctcatgcagaaactgaagaaatccgggtctctactgcagctgaccttcagggataatgctgatttgcgcaaatgtttcctctaccaactaagccaaaaaacagggctgcagtattttaaaaacgtcgtgctggttgcttctccccaagaccgttatgtgccatttcattcagccaggattgaaatgtgtaaaactgccctcaaagacagacacacagggccagtttatgcagaaatgatcaacaacctcctgggccctctggttgaagccaaggactgcactttaatccgacacaacgtgttccacgccctgcccaacactgccaacaccctgatcggccgagccgctcacatcgctgtgctggattcagaactcttcctggagaagtttttcttggtggcaggactcaactacttcaagtagtggctttgagggagcaggtctttggtaatgcttacgatcggtggagagctttagctgagacctgcttttacagacctcaccatttcagaatgaagcttcaacagcattgggggacggaggctcgggtggaacctgacatgagaggtgcttttgttttggagattcgagaaagctgagcaaatagactaaatgacaacaaactttgcttgaatttgtatagttacctggagtgtcattcaagatgttttctaggaaaaatatgagagaataaacagaatacttgggagttggtgagctccccttgctagccactactggcttactgagagattactccaatttaactagacttgccgaatatgttactagcttatagctttatcatttctgattaagtgcacacaagcatttcagaactcaggttaatctctgtgcagcagtggaacatatttgtgtaaatagaatcctcaatagattcaaatgtgtcagttgttcaagaaaatgtgatgcccatattcatattctctcctcatgttttctaaacaagggagcaaggaatgtgttacaaatcccagttctatttcataacagcagtgagcagggtgacttaaggtaaagagggataaaggtgacactattggtaaatacaagtttgttacaaagaaacatgactctagggacatactgaactatgaatagttgctccacctacttccccagaattcttctatgcagagccctgatccacaaattattttagtgattgcttacatctttgtctgtagtagggaacactgagtgagactaacctagcagaagggggcactgagatgaatgcacacacgtgtgaagctcctgctgatacacttccaaagacatgctatgttagcatttgatgcaattgcaaaaaattaaatccattaaagtggccagctgcttctcctctccatggaaggaggaaaacatctaaatggaggagtgctggattaaaacctcaggggagctctaagaagggtgctggctatctttcaatagaaatgtcttcttgccttaggaaaataaagggctaggaaaggtcactgcgttgataaaaaccaatagacgacagggacaaaagtgagatcagataggaggagaacaaccagactgaagactcaacataagctgttattggtaagtgactcaaaggggagttttgaaaattaccaggatgtttaatagtcaggtctcaaagactgagtatgttgtatgggctaaagtaagcctaaagaatcatttcgttgtatggaagagatgaatgaacctggacagtagggataagtaagacaggagcctaatcttttggagatgaaagctcctgcttctgcaaaaatcccttctgaagtgtggaaacgcatctaggaccagggttctcaatacctagaccatgactctaggtcactgatgccatggtaacaaaaccaagtaaatctaagctcatttgagaattttagatcctcttatgttaacaatgtgactttgaaaaataaaagcagaccatgggaatgagtccagatgggcagctttgcaggagtgtagacatgtggtattcttttgaagaaagagagggtcgttgagggagagttgaatgtcttgcaaaggcagagttccacacaatggatttagggtttctcagtgagtcctttctaaatgcttgttatatcctggtcataatgcatatgggttcactgagtcctctggtcactttccactggggatttttatctgagctcccgagtcagagctgggcatagactctggttcttcatgaggagtgctgtatttgctctgtaacctgggagacatttgttccctagtcgtgcagcacatggtattgtgtttcctgacctaggcaagtgcccatgctcagtacagaaccataagttggtagcagcttctcctttctggccaaatgatgggccctgtccctctgatgagtgcatttcatgttgtgtttccaattttcatcagcaatgttcgtcattccctggtcctttgaaagactgtgtagcccgcggttatggagccgggatgaatctgatgatcatcatcttctccaataaccagatgccatttttaacttcaatatgctgtctggacatagtgagaactaatggcaataaacgtccagctgcatggtgcacctcttttttataggggtgctctgctgtctttgtaaaccctctctggcctctgagcatctattataattgtgtagaaagtacatctctatattgtaaataagagtgtcgagtgttgcgtgtcatgcctcatttgaaaaggcttttttatgtctctttctattgaaatatagatatcgaatatataaatatatatacataaaatatatataaatatatattatgtaaaacagggacattctattattgattgtaaaaattataaacaaaatgcctgccaagataatggtcttgtatgtcttcattctctgcgtaatttttgtttttgtttttatgatttgttgtttcccaaaatgagttagaaataaaaatgcccaatattgagattaa

SEQ ID NO: 2166 - DNA, 684 bp, Homo sapiens
attgaatcaatacagcctgtgtttctcatgatcgcctggtccttgagactgttgataaggcattagagagcttcatggttgttgataatctgaggaacgccctctctagtgacagactgtcacggacatggaggattttttgaagtgccttttcaattttatgagttgaggatcctgcagccctggagatttataattgtccctgccactgctgctttgtgccttcttctagtttctgccttgtttatctggttttcttcccccatagtattttggcaattgtgaaaagtggttctggagaagtaccaacaaatgctcttactgcccgagaactgacacttttggaggctactgatgtttacggcaaaatagcctgagtcctttaatgtccttctttgattgttctaccagctacgattcctgcaaatccctgtcattcttcatcacaaagttatagaggtaatgagccaaaaagatcatgtctgaaatacaaggaacggttgagttttcggtagagctacataaattttataatgtggatctctttcagagagggtattaccagatccgagtgaccttgaaggtgtcttcaaggatcccccacagactgagtgcctccatcgctgggcagacagaggttctaaatatacatatgtcagaacaagaaccagcacaaggtaagta

SEQ ID NO: 2167 - DNA, 1358 bp, Homo sapiens
gttatctccagaggggatattacagggctgcagagcagaccaggcccggtggagaattaggtgctgctgggagctcctgcctcccacaggattccagctgcagggagcctcagggactctgggccgcacggagttgggggcattccccagagagcgtcgccatggtctgcagggagcagttatcaaagaatcaggtcaagtgggtgtttgccggcattacctgtgtgtctgtggtggtcattgccgcaatagtccttgccatcaccctgcggcggccaggctgtgagctggaggcctgcagccctgatgccgacatgctggactacctgctgagcctgggccagatcagccggcgagatgccttggaggtcacctggtaccacgcagccaacagcaagaaagccatgacagctgccctgaacagcaacatcacagtcctggaggctgacgtcaatgtagaagggctcggcacagccaatgagacaggagttcccatcatggcacacccccccactatctacagtgacaacacactggagcagtggctggacgctgtgctgggctcttcccaaaagggcatcaaactggacttcaagaacatcaaggcagtgggcccctccctggacctcctgcggcagctgacagaggaaggcaaagtccggcggcccatatggatcaacgctgacatcttaaagggccccaacatgctcatctcaactgaggtcaatgccacacagttcctggccctggtccaggagaagtatcccaaggctaccctatctccaggctggaccaccttctacatgtccacgtccccaaacaggacgtacacccaagccatggtggagaagatgcacgagctggtgggaggagtgccccagagggtcaccttccctgtacggtcttccatggtgcgggctgcctggccccacttcagctggctgctgagccaatctgagaggtacagcctgacgctgtggcaggctgcctcggaccccatgtcggtggaagatctgctctacgtccgggataacactgctgtccaccaagtctactatgacatctttgagcctctcctgctcacagatatgctagagttgtgccaggggctctggcaacctgtgtccttccagatgcaggccatgctgctgggccacagcacagctggagccataggcaggctgctggcatcctccccccgggccaccgtcacagtggagcacaacccagctgggggcgactatgcctctgtgaggacagcattgctggcagctagggctgtggacaggacccgagtctactacaggctaccccagggctaccacaaggacttgctggctcatgttggtagaaactga

SEQ ID NO: 2168 - DNA, 2005 bp, Homo sapiens
gttatctccagaggggatattacagggctgcagagcagaccaggcccggtggagaattaggtgctgctgggagctcctgcctcccacaggattccagctgcagggagcctcagggactctgggccgcacggagttgggggcattccccagagagcgtcgccatggtctgcagggagcagttatcaaagaatcaggtcaagtgggtgtttgccggcattacctgtgtgtctgtggtggtcattgccgcaatagtccttgccatcaccctgcggcggccaggctgtgagctggaggcctgcagccctgatgccgacatgctggactacctgctgagcctgggccagatcagccggcgagatgccttggaggtcacctggtaccacgcagccaacagcaagaaagccatgacagctgccctgaacagcaacatcacagtcctggaggctgacgtcaatgtagaagggctcggcacagccaatgagacaggagttcccatcatggcacacccccccactatctacagtgacaacacactggagcagtggctggacgctgtgctgggctcttcccaaaagggcatcaaactggacttcaagaacatcaaggcagtgggcccctccctggacctcctgcggcagctgacagaggaaggcaaagtccggcggcccatatggatcaacgctgacatcttaaagggccccaacatgctcatctcaactgaggtcaatgccacacagttcctggccctggtccaggagaagtatcccaaggctaccctatctccaggctggaccaccttctacatgtccacgtccccaaacaggacgtacacccaagccatggtggagaagatgcacgagctggtgggaggagtgccccagagggtcaccttccctgtacggtcttccatggtgcgggctgcctggccccacttcagctggctgctgagccaatctgagaggtacagcctgacgctgtggcaggctgcctcggaccccatgtcggtggaagatctgctctacgtccgggataacactgctgtccaccaagtctactatgacatctttgagcctctcctgtcacagttcaagcagctggccttgaatgccacacggaaaccaatgtactacacgggaggcagcctgatccctcttctccagctgcctggggatgacggtctgaatgtggagtggctggttcctgacgtccagggcagcggtaaaacagcaacaatgaccctcccagacacagaaggcatgatcctgctgaacactggcctcgagggaactgtggctgaaaaccccgtgcccattgttcatactccaagtggcaacatcctgacgctggagtcctgcctgcagcagctggccacacatcccggacactggggcatccatttgcaaatagcggagcccgcagccctccggccatccctggccttgctggcacgcctctccagccttggcctcttgcattggcctgtgtgggttggggccaaaatctcccacgggagtttttcggtccccggccatgtggctggcagagagctgcttacagctgtggctgaggtcttcccccacgtgactgtggcaccaggctggcctgaggaggtgctgggcagtggctacagggaacagctgctcacagatatgctagagttgtgccaggggctctggcaacctgtgtccttccagatgcaggccatgctgctgggccacagcacagctggagccataggcaggctgctggcatcctccccccgggccaccgtcacagtggagcacaacccagctgggggcgactatgcctctgtgaggacagcattgctggcagctagggctgtggacaggacccgagtctactacaggctaccccagggctaccacaaggacttgctggctcatgttggtagaaactgagcacccaggggtggtgggccagcggacctcagggcggaggcttcccacggggaggcaggaagaaataaaggtctttggctttctcc

SEQ ID NO: 2169 - DNA, 1446 bp, Homo sapiens
gttatctccagaggggatattacagggctgcagagcagaccaggcccggtggagaattaggtgctgctgggagctcctgcctcccacaggattccagctgcagggagcctcagggactctgggccgcacggagttgggggcattccccagagagcgtcgccatggtctgcagggagcagttatcaaagaatcaggtcaagtgggtgtttgccggcattacctgtgtgtctgtggtggtcattgccgcaatagtccttgccatcaccctgcggcggccaggctgtgagctggaggcctgcagccctgatgccgacatgctggactacctgctgagcctgggccagatcagccggcgagatgccttggaggtcacctggtaccacgcagccaacagcaagaaagccatgacagctgccctgaacagcaacatcacagtcctggaggctgacgtcaatgtagaagggctcggcacagccaatgagacaggagttcccatcatggcacacccccccactatctacagtgacaacacactggagcagtggctggacgctgtgctgggctcttcccaaaagggcatcaaactggacttcaagaacatcaaggcagtgggcccctccctggacctcctgcggcagctgacagaggaaggcaaagtccggcggcccatatggatcaacgctgacatcttaaagggccccaacatgctcatctcaactgaggtcaatgccacacagttcctggccctggtccaggagaagtatcccaaggctaccctatctccaggctggaccaccttctacatgtccacgtccccaaacaggacgtacacccaagccatggtggagaagatgcacgagctggtgggaggagtgccccagagggtcaccttccctgtacggtcttccatggtgcgggctgcctggccccacttcagctggctgctgagccaatctgagaggtacagcctgacgctgtggcaggctgcctcggaccccatgtcggtggaagatctgctctacgtccgggataacactgctgtccaccaagtctactatgacatctttgagcctctcctctgctcacagatatgctagagttgtgccaggggctctggcaacctgtgtccttccagatgcaggccatgctgctgggccacagcacagctggagccataggcaggctgctggcatcctccccccgggccaccgtcacagtggagcacaacccagctgggggcgactatgcctctgtgaggacagcattgctggcagctagggctgtggacaggacccgagtctactacaggctaccccagggctaccacaaggacttgctggctcatgttggtagaaactgagcacccaggggtggtgggccagcggacctcagggcggaggcttcccacggggaggcaggaagaaataaaggtctttggctttctcc

SEQ ID NO: 2170 - DNA, 2043 bp, Homo sapiens
gagagaaagagagagaggagagagaagaaacgggaggaggggataaggaaattaaaccctttaagtcaatgcatattgtggtgacaccggcacaggcgccctcacggtggagtcggccagggctgtgcgttcccaaaatatgaccaggggtgcttggatgtgtcggcagtatgacgacggcttaaaaatctggttggcagcaccccgagagaacgagaaaccgttcatcgattccgagagggctcagaaatggcgactgtctctggcatctctcttgtttttcacagtcctgctctctgatcacttgtggttctgcgccgaggccaagctgacccgggcccgggacaaggagcaccagcagcagcagcggcagcagcagcagcagcagcagcagcagaggcagcggcagcagcagcagcagcagcggcggcagcaggagccctcctggcccgcgctcctggcgagcatgggggagtcctcgcccgccgcccaggcacacagactcctctccgcctcctcgtcccccaccctgcccccctccccgggagacggcggcggcggcggcggcaagggcaaccgaggcaaagacgaccggggcaaggctctttttctaggaaactctgccaagcccgtgtggcgcctggagacttgttacccccagggcgcgtcctcgggccagtgcttcacggtggagaatgcggacgcggtgtgcgccaggaactggagtcggggggcggccgggggggacgggcaggaggtgaggagcaagcatcccactccgctctggaacttgtcggatttttacctttcgttttgtaattcctacacactttgggagttgttctcggggttgtccagtcccaacactttgaactgcagtctggatgtggtgctcaaggaaggcggcgagatgaccacttgcaggcagtgcgtcgaggcttaccaggactatgaccaccatgctcaggagaaatacgaagagtttgaaagcgtgctccacaaatatttacagtcggaggagtactcggtgaaatcctgtcctgaagactgtaagattgtctacaaagcctggctctgttcccagtattttgaagtcacacagtttaactgcagaaagacaattccttgcaagcaatactgtttggaggttcagacgaggtgtccatttatattgcccgacaatgatgaagtcatctacggaggcctctccagtttcatctgtacagggctttatgaaacctttctaaccaatgatgaaccagaatgctgtgacgtcaggagagaagaaaaatcaaataacccatccaaagggaccgtagagaaaagtggctcctgtcacaggacatcgctcacagtgtcatcagcaacaagactgtgcaacagcagactcaagctgtgtgttcttgtactgattctcttacacacagtgctcacagcctcggcagcacagaacacagccggactgagctttggaggcatcaacacgctggaagaaaactcaaccaatgaggagtaacggaaggacgagtgtcaccacagcagcagctggcccgccgtgaaaaatggcaactgctgtctcatgtaacagaaactgggtgcttttaccctcgaattacttattgcaaggcctttagggtaaaatttaaacagatgggcctgaatccaaacaaggacacaaccacagctttttattgactaaaaggctggaaagtgactttaaatttctcacaccattttatacactgtgttttaatgtttggaggttttatttgctttcgttttggtttgggtttatttgtttgtttattttttgcacttgttaatacaggatttattttgggggatggtttctcagaggtaaactaagtcttttcactgtctctatctctctatatatttctagtcattgtgtgtgttcatcagatagttctgtctttatgtcctgtcagcttctattagaggaatgattgctatgacctcatggtatagcaaaaaacaacaacaaaaaaagaataaaaaataaaaaagacaaaaaaaagaaaa

SEQ ID NO: 2171 - DNA, 4013 bp, Homo sapiens
ctcgcgcctgcctgttccctccagcccggacccccctgaaatatgttcaggggcgcttggatgtggcccgggaaagacgccgccgcgctgactatctgctgctgctgctgctgctgggctcccaggccgagcgacaaaccttgcgccgactccgagcgggcgcagcgatggcgactgtccctggcgtccctgctcttcttcaccgtgctgctcgctgaccatctgtggctgtgcgcgggggcccggccccgggccagggagctgagcagcgccatgcggcccccatggggggccggccgggagcggcagccggtgcctcctcgcgcggtgctgccgctgccgccgccgccgcccggcgagcccagcgcgcccccaggcacctgcggccccagatacagcaacctgaccaaagccgcccccgccgccggctctcggccggtctgcggcggcgtcccagagcccacggggctggacgcagcttgcaccaaattgcaatctttgcagagacttttcgaaccgactactccggccccccctctgcggccccctgactccctttcccgtgccccggccgagttcccctccgccaaaaaaaacttgctcaaaggccactttcggaacttcactctctccttttgcgacacctacacggtctgggacttgctgctgggcatggaccgccccgacagcctggactgtagcctggacaccctgatgggggacctgctggccgtggtggccagcccgggctccggggcctgggaggcgtgtagcaactgtatcgaggcgtaccagcggctggaccgacacgctcaggaaaaatatgacgagttcgacctcgtgctgcataaatacttacaggcggaagagtactcaatccggtcctgcacgaaaggctgtaaggctgtctacaaggcctggctgtgctcagaatacttcagcgtgacccagcaggaatgccagcgctgggtgccctgcaagcaatactgcctggaggtgcagacccggtgcccctttatactccccgacaatgaggaaatggtgtacggagggctccctggctttatctgtacagggttgctggatacttcaccaaagcgtctggaaaccaagtgctgtgacgtgcagtgggtctcctgtgaggcgaagaagaagaagttcaaggagtctgaggcccccaaaacccaccagcagcaattccaccactcctatttccaccactaccaccaacagtaccatcactaccacccccatcatgatcccccaggccgtgtcagcaacaagcccgccctgctgccggtctctgggggctcccgcctcagccctagcaggatccggctctgcgtccttgttctcatgctcctccataccgtggtgtccttctccagcaaccagggtggtgggggattggggctggagacactgcctgccctagaggagggcctgacacgggaagagtgacagtagggagggaggacagacctccaccacactgacatcagctccagctcccccaggttgggggggagggggctcctcccatgggaggtgtaggataaggtgggggcgggggaaatgggggaatgacacatcccccccaacctacccccaccccaaaagcagctccaacagaatggccagagggcctcagggagctgcaaaactcatccaggagaaaaaggcaggagcagcaagtgacccctcccaagctcccatctatggggcttagcaaaaaaagggaggaagtgggggctggatatgcccacccctgccaaaagccctgaccccagggaaggaggctgctcacccagccttggccctgcagggaatgttggggggcacagaggggagaagctctttcccccactccacattccttttgttgccaagatccttaattccctcctgcccatatccctacaggcgacggcagacagtgcaatggccctcctgccacttcagcacaccttgccccacctgggaccatcacacgtgaagcaccaggctgggagatgaggtgcacacagttgcagctaggtcggggccccagttaagctgtgccccaccaccctaggcaatgaggggcaggaaaggggtacagaatgaatggtgaaagagagtggagatacggaagggggagaggagaggagaaatgtggacagagggcttgaagacatggccgaataggctactgccacccggctttggggagatgggcgataagtgttgaggtaggctcgagaactgctccccaaatcagtgagaattgcattaggagccctctggggaaagagcacaggaactgagttgctgggcctcaaaacaaaaggctgcaggcacatggttagactgccgctgtctgaaggaccatatcttacagaaggtgcacatactcccaagggccactcttgccctggagatcttggccttggggccaaagacatttccatttccgatctccatggggaggagggacttaagcccaagtgggtcaggcctggcccaggtccttatactcccctatcttgtcctagcccaggcctccatgaaggagaacctggtggcattgccccagagctctccagagatgagcctcccctatccccaccctgtccccgtccccagcctaccaaagagtattcacacctttccatccctgactctatgggttactgtcccaattgcgaaacacccatactcctcttcaccctgtagcagggtcttctgctccagtcaccccggcctcttgcaagagaaagtccagggactggcaagaagaccctttgactaaagataatgtgctgtcatatcttggctgagaaactgttgagtcaggctagaggactggacaagagaagaggcattgagagcccccttgggagccattagccttgctctggtctgctgtgtggggttggggagtaggggggatcccacattgcctgggacatctgaatgctgatacgaatggacaggaaagggagccagagctgtatacctgggacaggccagggagcctttagtgccagcagggcctgtgtcctgggatgtgatgctagtgagtgaatgggagggcgggcctggagctgcgtgagagtgaaaccaagaagcggatggggaagggagagctggccttggtcagcttagggatgaatggagaaggaatcattcatgggcctcggctaggtcccagactgattacatgagactggggagtccttccctgccagttttctcatttattacagcctatcccccaaccctacccctgtgccctgcctacacactcccgtttggccctcagcactttgggcctggtcacataccccatccctagagtgctcttttcagctggggaggggaagaggtgctggctcctttccagacatgcttatgtataagtaaaggggcaggtgcttgggctccagagagaccctaggtactgccttctaactcctgcatcctcagaaggggaaaagggactgggaagtaaagggaaaccatatggccccagggaatggacccttggagactcccatcctctcttccccctcaccaagtgcccaggagacccctggctcagaccagcccaaggccttgcccagtggcaggggaaaggggcacctcactccacctcaaagtcatttgactgcccccatccaccccaccaccctaatcttccaccacctctccggctgcccctgccctccatcacagacagcagagccgggcagctttcttatgccattttctacactgtgcttcatgagtaggactttcttgcactagttcctatgactgagtctccaaactggtttcctagtagtcccccatcccttcctcccttacccagctatgattcagttgtctctgccctccctcttaccctgcctctgtgtttcggtgagagtctctgtatatgtactgctttctgttttgttgcattgtggggcagaggcctctctgctcttgtttaaccccataaagaaataaatggtaagacttgatgataa

SEQ ID NO: 2172 - DNA, 2945 bp, Homo sapiens
gagaacgcgcgtgagagagcccgagagagacggagagcgagcgagcgcgcgggagagactgagagcggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagagaatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaaaa

SEQ ID NO: 2173 - DNA, 2032 bp, Homo sapiens
aattacgagcgggcggcgctgcgtttccagggcagaggaaacgaggcgccgcgttggcgcttggacggcgggaaccggctccggagcgagaacgcgcatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttggtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaaaa

SEQ ID NO: 2174 - DNA, 2537 bp, Homo sapiens
ttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaaaa

SEQ ID NO: 2175 - DNA, 914 bp, Homo sapiens
ccagttcccacgtccctcgcccgggaagtcacgtccgctacagggagtgtcttcccatggcctccggaagcattcggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtga

SEQ ID NO: 2176 - DNA, 896 bp, Homo sapiens
gccacagattcccatctgcatctccaataccatttccctctactcactgacccgttgggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacagga

SEQ ID NO: 2177 - DNA, 1340 bp, Homo sapiens
caactgacagtcccaaaggggctggagatgccaccccggcaaagttcgccctagtcatttgcttcacgccttccagacagagggagcagttggaaaaaagtcagaggctgagtcgttccaacatggcgcagatgccacaaggacactagcacaccagcaggaagctgaacagaaggctggaggtgccacggtgacaaggacgggatcctgtcaggccaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttc

SEQ ID NO: 2178 - DNA, 761 bp, Homo sapiens
gattgcggagctgaagttcaggcagcgggagcgaggaggatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagc

SEQ ID NO: 2179 - DNA, 964 bp, Homo sapiens
gatggtcttaacccttcaattacgagcgggcggcgctgcgtttccagggcagaggaaacgaggcgccgcgttggcgcttggacggcgggaaccggctccggagcgagaacgcgcgtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaa

SEQ ID NO: 2180 - DNA, 1135 bp, Homo sapiens
gaggctgagtcgttccaacatggcgcagatgccacaaggacactagcacaccagcaggaagctgaacagaaggctggaggtgccacggtgacaaggacgggatcctgtcaggccagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggag

SEQ ID NO: 2181 - DNA, 567 bp, Homo sapiens
acgattgcggagctgaagttcaggcagcgggagcgaggagggtgaaaggtgtagcagtcactcggcctacacccacagcatcgaccttgtgaacccagcgacctgactgccttggtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccag

SEQ ID NO: 2182 - DNA, 753 bp, Homo sapiens
ggcgcttggacggcgggaaccggctccggagcgagaacgcgcccgcttatgagaatatgaaactaaggagagccacaggtgaaaggtgtagcagtcactcggcctacacccacagcatcgaccttgtgaacccagcgacctgactgccttggaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgcc

SEQ ID NO: 2183 - DNA, 510 bp, Homo sapiens
caactgacagtcccaaaggggctggagatgccaccccggcaaagttcgccctagtcatttgcttcacgccttccagacagagggagcagttggaaaaaagtcagaggctgagtcgttccaacatggcgcagatgccacaaggacactagcacaccagcaggaagctgaacagaaggctggaggtgccacggtgacaaggacgggatcctgtcaggccaggtgaaaggtgtagcagtcactcggcctacacccacagcatcgaccttgtgaacccagcgacctgactgccttggaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccac

SEQ ID NO: 2184 - DNA, 697 bp, Homo sapiens
gtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacggaatttggaaacgatttccataggcatgagcagccttttcgactagatgcaaacccagtggtcaggaaggcgaacatacaaaagggtgtgtccccatggtgcaaacgcttacagttgagtaaaagtctcccttgtgagtggatgaaaatgaacgctcatgggcagagcaccttctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcaga

SEQ ID NO: 2185 - DNA, 1686 bp, Homo sapiens
gacaggcacgacgattgcggagctgaagttcaggcagcgggagcgaggagggtgtgtggcttttgatacagtagagttctttggcctactcaccaactgacagtcccaaaggggctggagatgccaccccggcaaagttcgccctagtcatttgcttcacgtgaaaggtgtagcagtcactcggcctacacccacagcatcgaccttgtgaacccagcgacctgactgccttggtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaaaa

SEQ ID NO: 2186 - DNA, 2946 bp, Homo sapiens
gagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaaaa

SEQ ID NO: 2187 - DNA, 2537 bp, Homo sapiens; identical to SEQ ID NO: 2174

SEQ ID NO: 2188 - DNA, 2049 bp, Homo sapiens
gatggtcttaacccttcaattacgagcgggcggcgctgcgtttccagggcagaggaaacgaggcgccgcgttggcgcttggacggcgggaaccggctccggagcgagaacgcgcatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttggtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaaaa

SEQ ID NO: 2189 - DNA, 1679 bp, Homo sapiens
gcggcgctgcgtttccagggcagaggaaacgaggcgccgcgttggcgcttggacggcgggaaccggctccggagcgagaacgcgcgtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaatacca

SEQ ID NO: 2190 - DNA, 1543 bp, Homo sapiens
actttggaaaagctttggccgagaggaagggtccattcagatggttggggagtggggcttagaattttatatttagtttacaaagatgatgggggctgtgttaaaaagaaaaaatatacagatcacagtacagggattgggaattgggggaggcactgggttagctgcaggtaaattataacagagtgactagggtaggctgggttgagaaggtgacaatttgacaaagatgtgaagggggaggagtcagtcaagcagatatctgtggtgaaggccttccagacagagggagcagttggaaaaaagtcagaggctgagtcgttccaacatggcgcagatgccacaaggacactagcacaccagcaggaagctgaacagaaggctggaggtgccacggtgacaaggacgggatcctgtcaggccaggtgaaaggtgtagcagtcactcggcctacacccacagcatcgaccttgtgaacccagcgacctgactgccttggaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttc

SEQ ID NO: 2191 - DNA, 1701 bp, Homo sapiens
accgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttggaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaaaa

SEQ ID NO: 2192 - DNA, 748 bp, Homo sapiens
gtctctgtctcggcttctctcggcccctgggtctcttcgtctctgccgttctcaggctcagctccgtctcgctcggtccctcgcttccccgccgggctctagccggccgtctggtggcccgaggtggcggcgggctgggcgcggggcgcgatgagcggcgcctgcacgagctacgtgagcgcagagcaggaggtggtgcgcggcttcagctgcccgcggccggggggcgaggcggccgctgtcttctgctgcggcttccgcgaccacaagtactgctgcgacgacccgcacagcttcttcccctacgagcacagctacatgtggtggctcagcattggcgctctcataggcctgtccgtagcagcagtggttcttctcgccttcattgttaccgcctgtgtgctctgctacctgttcatcagctctaagccccacacaaagttggacctgggcttgagcttacagacagcaggccctgaggaggtttctcctgactgccaaggtgtgaacacaggcatggcggcagaagtgccaaaagtgagccctctccagcagagttactcctgcttgaacccgcagctggagagcaatgaggggcaggctgtgaactccaaacgcctcctccatcattgcttcatggccacagtgaccaccagtgacattccaggcagccctgaggaagcctctgtacccaaccctgacctatgtggaccagtcccataaacattcaataaatgtctccatacca

SEQ ID NO: 2193 - DNA, 600 bp, Homo sapiens
ggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccggcacttacaacagagtgcctttacacaaacctacggattggcagaaaaagatcctcatatggtcaggtcgcttcaagaagatgaaatcccagagactgtctcgttggagatgcttgatgctgcaaagaacaagatgcgagtgaagatcagctatctaatgattgccctgacggtggtaggatgcatcttctggttattgagggcaagaagctgcccaaagacacgagactttaacaagcttgaacttagaaaagaaagctcgtctgaaagaggaagcagctatgaaggccaaaacagagtagcagaggtatccgtgttggctattttgaaaatccaggaattatgttataacgtgcctgtattaaaaaggatgtggtatgaggatccatttcataaagtatga

SEQ ID NO: 2194 - DNA, 3052 bp, Homo sapiens
actccaacgctgggtgacattgagctcaccagcgccaccgtccccggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaataatgactgtgttttattgttttgatccaagtcaagtgtagcctctcagccttttggagaaaaatgaaacaatttatttcaacttgaataccaactcttcagagaagcaggtaccatatcttacttctcttcccattatcaaagtaacctctccacaggcgaactcattttgaggagataaggaaggccagttgagtatatggcccaggtgcagcttggagggccagccttctcaaatgtcctggtgtactggtggggaggctgccccctaatagagcgagcgctgagaagcagccagaccacattctataatctttgaacatgctggcagatggaggcttttaggagaatagttttttaaacattctgacaaggtccagccaggaatttctaaggacttagaaatcccagcgtcatggagttgcttggggtcaacacaagtcacctcttagcttcatgccttagaattctcaactggctgttttcttaccacctgagaaactaaatttctcaattataaaaatctcatgtattattactgttagaagtatttgcacctcatatatatctcatttacagtttgaccttgggatatcgagttgtctcatatttaggtatgaatacaggtttctattttaaacattgattctcacatgcttcttaattattcatggatgacaagccattatagtagtcccttcttatccacggctttgttttctgtggtttcagttacctgaggtctgaaaatattaaatggaaaattcctataacaatgcataagttatagattacataccattcagtgtagcatgatgaaatctcttgccaatctgttccatccacctgggatgtgaatcatccctctctctggtgtattcacactgtatgtgctagccgtctctgttacgagatcagctgtcgtggaatcagtgctagtgttcaggtaactcttatttaataattgcctcaaagtgcattgtgctgtgcctaatttataaaataaacggtatcataggtatgtatgtatacgaaaaacatagtatatgcagggttgggtactatccacagtttcaggcatctactggggggtcttggaatatatccccagagggtaaggggtgactactgtatacagccatgccaacatgctggttctcagagagttataagagagattaaaaatacatgcagctgtttgggcactttcttcccaaataaaatacccagtaaaatgtaacatactacctatagcttgataatctatctgaggatgtttatgatgtctgtctatatactttaatttggccttagcttctttgtaggtatcaagttatcacttgcaaatttattttcaaaaagcatagtttcttgtacattttagaagattagtttttcttattttgggacacctacaccaatgttttaaatgtggataaattttaatgtggaatttcttttaaaaataatcctcttcatagagcaatacaacaaaaatgtgttgtatcttggagatttacattataaatgtagtaacatttatgagcttaaatttaatgaaaccttttttttttttttgagacagtcttgcactgtcgcccaggctagagtgcagggcatgatctcagctcactgcaacctccgtctcccgggttcaagcaattctcgtgcctcagcctcctcagtaactggcattataggtgtgcaccaccacacctggctaatttttgtatttttcataaagacgggggtttcaccatgttggccaggctggtctcaaactcctgacctcaggtgatcagcctccctcggcctcccaaagtgctgggattacaggcatgagccatggtgcctggccaaacgtttttattacaaatattacattaaactaaagctcacaactgttattatgcatcaggaattaacagtcatttctcatttgtgttattctcctatttgataacatatagtgactatctctttatgggttaaatatcagtttcttggccagaattcaagatctgcccctaactaatcctacttctcccagtacccttacagcactcctaccctactagtaactctgatatctcatagtcctcagatttatcaagcaaacgaaactgaatgagcactactataaggtaccacaaactacaaaaggagacagttttgcccttgttgctttcagttaaattattgtgctattttttgcttaatttctaggttttttttgcgtgtttatcatgtctccgtaggtaaagtgggcagaaatctttttctactttacatttcctgtaagtgctgtttgtttgaataaagttaatgtgtgaggtta

SEQ ID NO: 2195 - DNA, 1033 bp, Homo sapiens
agctgagtgtgcgagcgccaggggttccagctgcacgtcccaggctctccagcgcgcggcaggccggggcgggacgaggagagctgcggggacaacgcctgtggctgggtccggaggtgcgggtgcggcgcgggacaagcgggcagcatgctcagggcggtcgggagcctactgcgccttggccgcgggctaacagtccgctgcggccccggggcgcctctcgaggccacgcgacggcccgcaccggctcttccgccccggggtctcccctgctactccagcggcggggcccccagcaattctgggccccaaggtcacggggagattcaccgagtccccacgcagcgcaggccttcgcagttcgacaagaaaatcctgctgtggacagggcgtttcaaatcgatggaggagatcccgcctcggatcccgccagaaatgatagacaccgcaagaaacaaagctcgagtgaaagcttgttacataatgattggactcacaattatcgcctgctttgctgtgatagtgtcagccaaaagggctgtagaacgacatgaatccttaacaagttggaacttggcaaagaaagctaagtggcgtgaagaagctgcattggctgcacaggctaaagctaaatgatattctaagtgacaaagtgttcacctgaataccatccctgtcatcagcaacagtagaagatgggaaaaatagaatatttaccaaaatatctgccatggttttattttggtaacaagaagcacaatgtcttttttatttttattttttagtaaacttttactgaagtataccatgcattcaaaaagtggacaaaactgtatacagtctgatagatatttatgtcgtgaacacctgtgtaaccactgccaaagtgaagatgtagaatattggcaacacttcacagcctcattcctgccttttctcagccattacctcccaaacatagcagtttttctgagtttcatcacctttgattcattttgcctgtttttgaactttatataaatggatttataca

SEQ ID NO: 2196 - DNA, 2909 bp, Homo sapiens
cgcgtgcatcagcctctctggcgggggattctccccggactccggccagcgccaatcaggtcgcgcggtacctgcccccagccctggccacctggaggggcgatgaggctccacgcccggagcagggcagtcctcggagcgccggggaggccgcggagcctcacgtgtgccgccccagccgctggcgcccggaaggacgcgctgcgaccccgtgggagccgaacgcgggagtcgctgcccgagcggagctgctcagccgcgggactgatgcccttggccagacgcacccccaactgctgtctgctcaggtgtagcccgcgtgactgagtcaccgctgctccagctgtttcacgtcgccgttccctttactgaatagtttgatggggcgccgggcggatgacagcgggaacggttgtgatcactggcggaatcctagctacggtgatcctcctctgcatcattgccgtcctgtgctactgcaggctccagtattactgctgcaagaagagcggaaccgaggttgcagacgaggaggaggagcgggagcacgaccttcccacgcatcccagaggccccacctgcaatgcctgcagctcccaagccctggacggcagaggcagcctggcgcctctcaccagcgagccctgcagccagccctgtggggtggccgcgagccactgcactacctgctccccatacagctcccccttttacatacggacggctgacatggtgcccaatgggggtggaggcgagaggctctcctttgctcccacatactacaaagaggggggacccccatccctcaaattggcagcaccccagagttacccggtgacctggccaggctctgggcgtgaggccttcaccaatccaagggctattagtacagacgtgtaaatccttccaccccgacccgcacacacacccacactgctgccctggcgggggccatgggggtgatgaatgaccctccaacagccccacatgggttgtttctgtttctttggcttttctcgctccgcagtggagggtttactaggatttaagcttttgagtgcattgagaaccaagacagggcctggctccaactctgtgggccagaggtgggggactgctaggtcgagtctgcagcttcgccagtttcttggttgggacactcctctggcagccccagcaccaccacaaccccttgcagtgtgccccagtcccctggattcgctggactgcaaaaaggagcaccagggaaagctcagcaaaggctcaggaggcctcccgggtcctcgggagatgaagcatccgtgcctaggaaaaggggacagagggcaaggagagaagtgagagctacaattccagcattggagaagcgaggggcggggcgtcaacggcactgcttcaggacgcgcttgctgaaacgactccaacagctagttcacagcccagctttgtacgttggttaccatagctactgctgtcactgtagctgctcccgtagggtcgttgattcctgaacgtatcacatctcacctgcccccttcctcgtgggacgtgtcaagttgactttaaagcctaaggtggcttgtggggactgcaccagaaagtgtctaaccttgtgttccccgaaatcctttctctgacttaggaaccagcgccccctgctggagaagttttttcattttgttagccgacttctggtagcttagcaaagagaccagctgactgtctctcggcccagcccaccacgccgagtagcttgtgtggatgcagtcctgtgagggtgtgcataaccgttcccaggtgtacgcacgcgcgcgcgcgcgcacagacacacacacacacacacacacacacacacacacacagtaaccacgggtaggcaccaggggctttgtacattcaggagctgcagagaggaaaggtctcccatgtaccagagaaggaaaagtctgatcccgaaacagcttgaacgaaaggtggttaacacgtgaccaatccccatggcagacagcgggctggtgaacaggaagagcacagaatctctgtggggcgatgctgcagcggctgaaaccacgtcaagtcccccagagcccggcattctatgtaagcatccacctgtgacgccgtggagcaggatcttcattcatctcaccagagcaacagcccagtcctgaggatgggagggacgtgacttagccttgggattccacgctcgccgccctcccttggccgccctactccccagtttcctggcgatgagccatttattgtgtctcacaccagcctcatttccaactccgacttcctacttagaatgtggcagtggctttgtgagtgagaatcctgatgagttttccagtggcctctgcagaagctggcccccttctaagggcatagctaacccccttcccactcctgagtcactgaattcgaggagggtggggcagggaaagggctggcccccctgctgaaatcttgattctgcatttgaggaaggtcagggtgccgctgggggagcagggagcggggagggaggaagaggggaatgcacatcttttgcgccactattaaggcacctgtcaccttacatctcaatctggaatcaaagtgccctgggttgagaagcagacctgggctctggtcacactttggtcactcattagctctaggaccagtcactaatctctgagactccattttctccagggaaacgaggcttgcccagatagactaacaaccctttagtgctccaagaagtgagaatttccgaaaaagatctgccggcccagagcactccctcttgccctaatcctggcagggtctggatgtatttacccaactctgatcttgcgtgcagggatgcttgctgatggatgaaagaccacaataaaacaagattagcagcaaaacaa

SEQ ID NO: 2197 - DNA, 589 bp, Homo sapiens
gctgttgatggagaagggggcggatgacagccgggaccgtggtcatcaccgggggcatcttggcgactgtgattttgctctgcatcatcgctgttctgtgctactgccggctccagtactactgctgcaagaaggacgagtcggaggaggacgaggaggaaccagacttcgccgttcactcgcacctgcccccgctgcactccaaccgcaacctggtgctgaccaacgggccggcgctctaccccaccgcctccacctccttcagccagaagtccccgcaggcccgcgccctctgccgcagctgctcccactgcgagccccccaccttcttcctgcaggagccgccggaggaggaagaggacgtgctgaacggcggggagcgcgtgctctacaagagcgtgagccaggaggacgtggagctgcccccggggggcttcgggggcctgcaggcgctcaaccccaaccgcctctcagccatgcgggaggccttcgccaggagccgcagcatcagcaccgacgtgtgacctgggcccgcccccgggatcctggccttgaaggtcctgagacaatggggggattcctttggcac

SEQ ID NO: 2198 - DNA, 811 bp, Homo sapiens
cccttctgccagcccacccccagccgggctctggataacatctcggagaccaaccgcggcagcacagggcagccgagcacttcctcgtctgtttattactgaacgcaggcatctgggagcccgcggagcatgaaattaggaacaaatgtgcaggaggtctagacaggaactctgcgggctgctctcctccgatcgaggacgccggggcccttgggcttccaggctgttgatggagaagggggcggatgacagccgggaccgtggtcatcaccgggggcatcttggcgactgtgattttgctctgcatcatcgctgttctgtgctactgccggctccagtactactgctgcaagaaggacgagtcggaggaggacgaggaggaaccagacttcgccgttcactcgcacctgcccccgctgcactccaaccgcaacctggtgctgaccaacgggccggcgctctaccccaccgcctccacctccttcagccagaagtccccgcaggcccgcgccctctgccgcagctgctcccactgcgagccccccaccttcttcctgcaggagccgccggaggaggaagaggacgtgctgaacggcggggagcgcgtgctctacaagagcgtgagccaggaggacgtggagctgcccccggggggcttcgggggcctgcaggcgctcaaccccaaccgcctctcagccatgcgggaggccttcgccaggagccgcagcatcagcaccgacgtgtgacctgggcccgcccccgggatcctggccttgaaggtcctgagacaatggggggattcctttggcac

SEQ ID NO: 2199 - DNA, 862 bp, Homo sapiens
tggtttgtgtgcggccaggcacaggaggctctgccgttgggagcaatgagaccttccagctccctggggctgaccttcccgccgcctctcatgtacttgtctggtgggggtttgtgttgatcagaagtgaattcatagttggtctaccatgaattggaaggttctcgaacacgtgcacctgctgctgtatatcttggcagcaaaaacattaattctctgcctggcatttgctggagtgaaaatataccaaagaaaaaggttggaagcaaaacagcaaaaactggaggctgaaaggaagaagcaatcagagaaaaaagataactgaatattctgcaatgtaaatgtcagcttgagtggactccggctgagaagaaagagaagaaatacttaattattgaataatgtgtcagaggataaagtcccaacctagacatttcacttaaaatactgtgaatttatatgtgcttttaaaagaaccagtattggctaggcatggtggctcacgcctgtaatcccagcactttgggaggctgaggagggcagaacgcttgaggtcgggagctcgagaccagcttggccaacatggtgaaaccccgtatctactaaaaatacaaaaattagccagtgtagtggtgcacgtctgtaatcccagctactcaggaggctgaggcaggagaattgcttgaacccaggaggtggaggttgcagtgagcctagatcatgccactggcctgttactccagcctgggcagcagagcaagactctgtctcaaaaaacatttttttaatttaaattttaaaaaataataataaaagaatcagtattttgtttactaaaataaaatacctttgtaaaaaaaaa

SEQ ID NO: 2200 - DNA, 850 bp, Homo sapiens
ccccggcaggacggtagaagtcgtggtttgtgcgcggccaggcgctggagcctccgctgccgggagcaatcagaccttccagctgcctctcatgtacttgtctgttgggggcttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaagattctgccatgtaaatgtcagcttgagtggactccagctgagaagaaagagaagaaagacttaattattgaataatttgtcagaggataaactcccaacctagacctttcacttaaaatagtgtgaatttgtatatgtttttaaaagaaccagtactggccgggtatgctggcttttacctgaaatcccagcactttgggaggccgaggcgagtggatcgcctgagatcgggagtttgagaccagcctggccaacatggtaaaatcctgtctctactaaaaatataaaaattagccaggtgtagtggcgcgcgtctgtaatcccagctactcgggaggctgaggcaggagaattgcttgaatccgggaggtggaggttgcagtgagcctaggtcgtgccactgccctccagcctgggtgacagagcgactgcgtctccaaaaaaaaaaaggtaaaattaaaattaaaaaaaataataataaccagtattttgtttactaaaataaaatgcctttgtaaaaaaagga

SEQ ID NO: 2201 - DNA, 1074 bp, Homo sapiens
aaattccaaaagctctttgggatgctgcgatgtcgcggccggccccgcgctcgggttttccctcctagacaaaagtctgccggctcccggtcgcgccgggtcggggatccggaaggtgaaggccgccaggccccacctgcggggcgcccctgctggacctggccgtcgggcgccgtcaacccgttgagcagcgtgttccggctggcacgtggcccgggcggggcccaggattggttcaagcctacggtgttggtccccggagagtctagggagacaagcaatcccctggaatgatcagaccttccagctgcctctcatgtacttgtctgttgggggcttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaagattctgccatgtaaatgtcagcttgagtggactccagctgagaagaaagagaagaaagacttaattattgaataatttgtcagaggataaactcccaacctagacctttcacttaaaatagtgtgaatttgtatatgtttttaaaagaaccagtactggccgggtatgctggcttttacctgaaatcccagcactttgggaggccgaggcgagtggatcgcctgagatcgggagtttgagaccagcctggccaacatggtaaaatcctgtctctactaaaaatataaaaattagccaggtgtagtggcgcgcgtctgtaatcccagctactcgggaggctgaggcaggagaattgcttgaatccgggaggtggaggttgcagtgagcctaggtcgtgccactgccctccagcctgggtgacagagcgactgcgtctccaaaaaaaaaaaggtaaaattaaaattaaaaaaaataataataaccagtattttgtttactaaaataaaatgcctttgtaaaaaaagg

SEQ ID NO: 2202 - DNA, 3789 bp, Homo sapiens
ggcggagatgagcaggtccgcgacgctgctgctgtgcctgctgggctgccacgtctggaaggcggtgaccaagacgctgcgggagcccggcgccggagcccaagaggtgacgttaaaggtgcacatcagcgacgccagcacccaccagcccgtagcagatgcgctcatcgagatcttcaccaaccaggcctccatagcctctggcacctcggggactgatggcgtcgcctttatcaagttccagtataagctgggcagtcagttgattgtcaccgcctcgaagcatgcctacgtgccaaactctgccccatggaagccaatccggttacctgtattttcctctctgagccttggcctgcttccagaacgctctgccactctaatggtatatgaagatgtcgtccaaatagtatcaggattccaaggaaacagcaccaggcatgacctgaccccagtcacagccgtcagcgtccacttgctgagcagtaatggaacgccggtgctggtggatggtcccatctatgtcactgtgcccctggccacgcagagcagcctgaggcacaatgcctatgtcgcggcgtggcggtttgaccagaagctgggaacgtggctgaagagcggtctgggtcttgtgcaccaggaaggcagccagctgacgtggacatacattgccccccagttggggtactgggtggccgccatgtcccctcccatcccaggtcccgttgtaacacaggacattaccacgtatcacacggtgtttcttttggccattttaggaggaatggctttcatacttttggttttgctgtgtctccttttatattattgcaggaggaagtgcttgaaacctcgtcagcaccacagaaaactgcagctccctgcaggactggagagttccaaaagagaccagtccacgtccatgtcacacattaacttgctgttttcacgccgagcgtcagaattccctggcccgctgtccgtcaccagccacggccgccccgaggcccccggcacgaaggaactgatgagtggagtccatttggaaatgatgtctccgggcggcgaaggggacctgcacacccccatgctcaagctctcctacagcacctcccaggaatttagctcccgggaggagctcctctcttgcaaggaagaggataaaagccagatctcctttgataacctcactccaagtgggacgctggggaaagactaccataagtcagtggaggtttttcccttaaaggcaagaaaatctatggaaagagaaggctacgagtcctcgggcaatgatgactacaggggtagttacaacaccgtgctctcacagcctttatttgaaaagcaggacagagaaggtccagcctccacgggaagcaaactcaccattcaggaacatctgtaccccgcgccttcatcacctgagaaagaacagctgctggaccgcagacccactgaatgtatgatgtcgcgatcagtagatcacctcgagagacctacgtccttcccacggcccggccagttaatctgctgcagttctgtcgaccaggtcaatgacagcgtttacaggaaagtactgcctgccttggtcatcccggctcattatatgaaactccccggggaccactcctatgtcagccagcccctcgtcgtcccggctgatcagcagcttgagatagaaagactacaggctgagctgtccaatccccatgccgggatcttcccacacccgtcctcacagatccagccccagcccctgtcttcccaggccatctctcagcagcacctgcaggatgcgggcacccgggagtggagccctcagaacgcatccatgtcggagtctctctccatcccagcttccctgaacgacgcggctttggctcagatgaacagtgaggtgcagctcctgactgaaaaggccctgatggagcttgggggtgggaagccgcttccgcacccccgggcgtggttcgtctccttggatggcaggtccaacgctcacgttagacattcatacattgatctccaaagagctggaaggaacggaagtaatgatgccagtttggactctggcgtagatatgaatgaaccaaaatcagcccggaagggaaggggagatgctttgtctctgcagcagaactacccgcccgtccaagagcaccagcagaaagagcctcgagccccagacagcacggcctacacgcagctcgtgtacctggatgacgtggaacagagtggtagcgaatgtgggaccacggtctgtacccccgaggacagtgccctgcgatgcttgttggaggggtcgagtcggagaagtggtggccagctgcccagcctgcaggaggagacgaccagacggactgcggatgccccctcggagccagcagccagcccccaccagagaagatctgcccacgaggaagaggaagacgatgatgatgatgaccaaggagaagacaagaaaagcccctggcagaaacgggaggagaggcccctgatggcgtttaacattaaatgagctatcgcagacccacctgactgtggaatataaaattgccaaatatcctttctcatggaagcgcgtacccgttcgtggaggaaacggaacggcagcccagccgtgggacggacgtggacgtttactgcattcctgtttgccgtgtaaatgttagaaaggaattaaagttattactcggaataaaggatgactttggcggatgtcgcccctgcaaggaggtggctgaaagtggtgtccagatgtccttccgaggactcggcgtatccgccaccagggacattaagaaaccgcacgtgatgtcgctatgctctaacgatcacctcagttctccctcggattctgggaacagatgaaactttttgcatcgcttgagtcatttttatcacaataatcctactgtgaagctgtcgttgagaacttaggttggcacgtagcgtctcaaggtatgcgttctctcaaaggaaagctatgcatcgctgcttcgttgtctgattttgcttagattttgctttggttaggttgcgttttggggtttgcctttttttgttgtcgcttaaatgcaatttggttgtaaagatttgattcctttgtgttcatctgttccgcttctcagcggtccatctcagcgtctcccttcaggaaccgctgagtgtcctctcttaacatccaagccttttaatgaaatcgtactgaaatctgtatcagctaagagtcctccaatcctggtcccattaactccaagtgcctttttgacagtgacaacagacagtccctcgctttttgttgttgttggttttcttaacccctttaatggaactgcctggattttatacagttattaaaggatgtctcttttgctttaaactgcatgctgccaagtgccatttggggtcagcatcctcgtttcaacacagtgtgctctctagttatcatgtgtaacgtgggttctgtttagcgaagatagactagaggacacgttagagatgcccttccctgctccatccctgtggcaccattatggttttttggctgtttgtatatacggttacgtattaactctggaatcctatgggctcatcttgctcacccaatgtgggagtctggtttgagcaagcgagctgaatgtgactattaaaaaaaatttaaaaaaaaaaaagaaaatcttatgtactatccaaaagtgccagaatgactcttctgtgcattcttcttaaagagctgcttggttatccaaaaatgaaaattcaaaataaactctgaagaaaagg

SEQ ID NO: 2203 - DNA, 3952 bp, Homo sapiens
ggcggagatgagcaggtccgcgacgctgctgctgtgcctgctgggctgccacgtctggaaggcggtgaccaagacgctgcgggagcccggcgccggagcccaagaggtgacgttaaaggtgcacatcagcgacgccagcacccaccagcccgtagcagatgcgctcatcgagatcttcaccaaccaggcctccatagcctctggcacctcggggactgatggcgtcgcctttatcaagttccagtataagctgggcagtcagttgattgtcaccgcctcgaagcatgcctacgtgccaaactctgccccatggaagccaatccggttacctgtattttcctctctgagccttggcctgcttccagaacgctctgccactctaatggtatatgaagatgtcgtccaaatagtatcaggattccaaggtgcccggccacagcctcgcgttcatttccagagaagggctctgaggttgcctgagaacaccagctacagtgacctgaccgcgtttctcacggccgccagctccccttcggaggtggacagttttccttatttgcgaggattagacggaaatggaacaggaaacagcaccaggcatgacctgaccccagtcacagccgtcagcgtccacttgctgagcagtaatggaacgccggtgctggtggatggtcccatctatgtcactgtgcccctggccacgcagagcagcctgaggcacaatgcctatgtcgcggcgtggcggtttgaccagaagctgggaacgtggctgaagagcggtctgggtcttgtgcaccaggaaggcagccagctgacgtggacatacattgccccccagttggggtactgggtggccgccatgtcccctcccatcccaggtcccgttgtaacacaggacattaccacgtatcacacggtgtttcttttggccattttaggaggaatggctttcatacttttggttttgctgtgtctccttttatattattgcaggaggaagtgcttgaaacctcgtcagcaccacagaaaactgcagctccctgcaggactggagagttccaaaagagaccagtccacgtccatgtcacacattaacttgctgttttcacgccgagcgtcagaattccctggcccgctgtccgtcaccagccacggccgccccgaggcccccggcacgaaggaactgatgagtggagtccatttggaaatgatgtctccgggcggcgaaggggacctgcacacccccatgctcaagctctcctacagcacctcccaggaatttagctcccgggaggagctcctctcttgcaaggaagaggataaaagccagatctcctttgataacctcactccaagtgggacgctggggaaagactaccataagtcagtggaggtttttcccttaaaggcaagaaaatctatggaaagagaaggctacgagtcctcgggcaatgatgactacaggggtagttacaacaccgtgctctcacagcctttatttgaaaagcaggacagagaaggtccagcctccacgggaagcaaactcaccattcaggaacatctgtaccccgcgccttcatcacctgagaaagaacagctgctggaccgcagacccactgaatgtatgatgtcgcgatcagtagatcacctcgagagacctacgtccttcccacggcccggccagttaatctgctgcagttctgtcgaccaggtcaatgacagcgtttacaggaaagtactgcctgccttggtcatcccggctcattatatgaaactccccggggaccactcctatgtcagccagcccctcgtcgtcccggctgatcagcagcttgagatagaaagactacaggctgagctgtccaatccccatgccgggatcttcccacacccgtcctcacagatccagccccagcccctgtcttcccaggccatctctcagcagcacctgcaggatgcgggcacccgggagtggagccctcagaacgcatccatgtcggagtctctctccatcccagcttccctgaacgacgcggctttggctcagatgaacagtgaggtgcagctcctgactgaaaaggccctgatggagcttgggggtgggaagccgcttccgcacccccgggcgtggttcgtctccttggatggcaggtccaacgctcacgttagacattcatacattgatctccaaagagctggaaggaacggaagtaatgatgccagtttggactctggcgtagatatgaatgaaccaaaatcagcccggaagggaaggggagatgctttgtctctgcagcagaactacccgcccgtccaagagcaccagcagaaagagcctcgagccccagacagcacggcctacacgcagctcgtgtacctggatgacgtggaacagagtggtagcgaatgtgggaccacggtctgtacccccgaggacagtgccctgcgatgcttgttggaggggtcgagtcggagaagtggtggccagctgcccagcctgcaggaggagacgaccagacggactgcggatgccccctcggagccagcagccagcccccaccagagaagatctgcccacgaggaagaggaagacgatgatgatgatgaccaaggagaagacaagaaaagcccctggcagaaacgggaggagaggcccctgatggcgtttaacattaaatgagctatcgcagacccacctgactgtggaatataaaattgccaaatatcctttctcatggaagcgcgtacccgttcgtggaggaaacggaacggcagcccagccgtgggacggacgtggacgtttactgcattcctgtttgccgtgtaaatgttagaaaggaattaaagttattactcggaataaaggatgactttggcggatgtcgcccctgcaaggaggtggctgaaagtggtgtccagatgtccttccgaggactcggcgtatccgccaccagggacattaagaaaccgcacgtgatgtcgctatgctctaacgatcacctcagttctccctcggattctgggaacagatgaaactttttgcatcgcttgagtcatttttatcacaataatcctactgtgaagctgtcgttgagaacttaggttggcacgtagcgtctcaaggtatgcgttctctcaaaggaaagctatgcatcgctgcttcgttgtctgattttgcttagattttgctttggttaggttgcgttttggggtttgcctttttttgttgtcgcttaaatgcaatttggttgtaaagatttgattcctttgtgttcatctgttccgcttctcagcggtccatctcagcgtctcccttcaggaaccgctgagtgtcctctcttaacatccaagccttttaatgaaatcgtactgaaatctgtatcagctaagagtcctccaatcctggtcccattaactccaagtgcctttttgacagtgacaacagacagtccctcgctttttgttgttgttggttttcttaacccctttaatggaactgcctggattttatacagttattaaaggatgtctcttttgctttaaactgcatgctgccaagtgccatttggggtcagcatcctcgtttcaacacagtgtgctctctagttatcatgtgtaacgtgggttctgtttagcgaagatagactagaggacacgttagagatgcccttccctgctccatccctgtggcaccattatggttttttggctgtttgtatatacggttacgtattaactctggaatcctatgggctcatcttgctcacccaatgtgggagtctggtttgagcaagcgagctgaatgtgactattaaaaaaaatttaaaaaaaaaaaagaaaatcttatgtactatccaaaagtgccagaatgactcttctgtgcattcttcttaaagagctgcttggttatccaaaaatgaaaattcaaaataaactctgaagaaaaggaaaa

SEQ ID NO: 2204 - DNA, 2670 bp, Homo sapiens
ggcggagatgagcaggtccgcgacgctgctgctgtgcctgctgggctgccacgtctggaaggcggtgacacgctgcgggagcccggcgccggagcccaagaggtgacgttaaaggtgcacatcagcgacgccagcacccaccagcccgtagcagatgcgctcatcgagatcttcaccaaccaggcctccatagcctctggcacctcggggactgatggcgtcgcctttatcaagttccagtataagctgggcagtcagttgattgtcaccgcctcgaagcatgcctacgtgccaaactctgccccatggaagccaatccggttacctgtattttcctctctgagccttggcctgcttccagaacgctctgccactctaatggtatatgaagatgtcgtccaaatagtatcaggattccaaggtgcccggccacagcctcgcgttcatttccagagaagggctctgaggttgcctgagaacaccagctacagtgacctgaccgcgtttctcacggccgccagctccccttcggaggtggacagttttccttatttgcgaggattagacggaaatggaacaggaaacagcaccaggcatgacctgaccccagtcacagccgtcagcgtccacttgctgagcagtaatggaacgccggtgctggtggatggtcccatctatgtcactgtgcccctggccacgcagagcagcctgaggcacaatgcctatgtcgcggcgtggcggtttgaccagaagctgggaacgtggctgaagagcggtctgggtcttgtgcaccaggaaggcagccagctgacgtggacatacattgccccccagttggggtactgggtggccgccatgtcccctcccatcccaggtcccgttgtaacacaggacattaccacgtatcacacggtgtttcttttggccattttaggaggaatggctttcatacttttggttttgctgtgtctccttttatattattgcaggaggaagtgcttgaaacctcgtcagcaccacagaaaactgcagctccctgcaggactggagagttccaaaagagaccagtccacgtccatgtcacacattaacttgctgttttcacgccgagcgtcagaattccctggcccgctgtccgtcaccagccacggccgccccgaggcccccggcacgaaggaactgatgagtggagtccatttggaaatgatgtctccgggcggcgaaggggacctgcacacccccatgctcaagctctcctacagcacctcccaggaatttagctcccgggaggagctcctctcttgcaaggaagaggataaaagccagatctcctttgataacctcactccaagtgggacgctggggaaagactaccataagtcagtggaggtttttcccttaaaggcaagaaaatctatggaaagagaaggctacgagtcctcgatgatgactacaggggtagttacaacaccgtgctctcacagcctttatttgaaaagcaggacagagaaggtccagcctccacgggaagcaaactcaccattcaggaacatctgtaccccgcgccttcatcacctgagaaagaacagctgctggaccgcagacccactgaatatgatgtcgcgatcagtagatcacctcgagagacctacgtccttcccacggcccggccagttaatctgctgcagttctgtcgaccaggtcaatgacagcgtttacaggaaagtactgcctgccttggtcatcccggctcattatatgaaactccccggggaccactcctatgtcagccagcccctcgtcgtcccggctgatcagcagcttgagatagaaagactacaggctgagctgtccaatccccatgccgggatcttcccacacccgtcctcacagatccagccccagcccctgtcttcccaggccatctctcagcagcacctgcaggatgcgggcacccgggagtggagccctcagaacgcatccatgtcggagtctctctccatcccagcttccctgaacgacgcggctttggctcagatgaacagtgaggtgcagctcctgactgaaaaggccctgatggagcttgggggtgggaagccgcttccgcacccccgggcgtggttcgtctccttggatggcaggtccaacgctcacgttagacattcatacattgatctccaaagagctggaaggaacggaagtaatgatgccagtttggactctggcgtagatatgaatgaaccaaaatcagcccggaagggaaggggagatgctttgtctctgcagcagaactacccgcccgtccaagagcaccagcagaaagagcctcgagccccagacagcacggcctacacgcagctcgtgtacctggatgacgtggaacagagtggtagcgaatgtgggaccacggtctgtacccccgaggacagtgccctgcgatgcttgttggaggggtcgagtcggagaagtggtggccagctgcccagcctgcaggaggagacgaccagacggactgcggatgccccctcggagccagcagccagcccccaccagagaagatctgcccacgaggaagaggaagacgatgatgatgatgaccaaggagaagacaagaaaagcccctggcagaaacgggaggagaggcccctgatggcgtttaacattaaatga

SEQ ID NO: 2205 - DNA, 605 bp, Homo sapiens
cgcggcggagatgagcaggtccgcgacgctgctgctgtgcctgctgggctgccacgtctggaaggcggtgaccaagacgctgcgggagcccggcgccggagcccaagaggtgacgttaaaggtgcacatcagcgacgccagcacccaccagcccgtagcagatgcgctcatcgagatcttcaccaaccaggcctccatagcctctggcacctcggggactgatggcgtcgcctttatcaagttccagtataagctgggcagtcagttgattgtcaccgcctcgaagcatgcctacgtgccaaactctgccccatggaagccaatccggttacctgtattttcctctctgagccttggcctgcttccagaacgctctgccactctaatggtatatgaagatgtcgtccaaatagtatcaggattccaaggaaacagcaccaggcatgacctgaccccagtcacagccgtcagcgtccacttgctgagcagtaatggaacgccggtgctggtggatggtcccatctatgtcactgtgcccctggccacgcagagcagcctgaggcacaatgcctatgtcgcggcgtggcggtttgaccagaagctgg

SEQ ID NO: 2206 - DNA, 3158 bp, Homo sapiens
gcttgcggcggctccggtcggagacaatcgcgctgagcgggcgccgcagcgggagcgggagccggagctgcgaggcgcggcgcagagctggggctgcgcggggccgggcgagcgggaccaggcgggagccatggaccgctagggcccggcctagccccgcgatgccgccggcgagtggccccagcgtcctcgcgcggctgttgccgctgctggggctgctgctcggcagcgcctcccgggctcccggcaagtcgccgccggagccccccagcccgcaggagatcctgatcaaggtgcaggtgtatgtgagcggggagctggtgcccctggcccgggcctcagtggatgtgtttgggaaccggactctgctggcagctggcaccacagactcagagggtgtggccaccctgcccctcagttatcgcttgggcacctgggtgctggtcactgctgcccgccctggcttcctcaccaactctgtgccctggcgtgttgacaagctgcccttgtatgcgtctgtcagcctctacctgctccctgagcggccggccacgctcatcctctatgaggacctggtgcacattctcctaggctctcccggtgcccgctcccagcccttggtgcagttccagcgccgggctgcccgcctgcctgtcagctccacctacagccagctctgggcgtcacttacgcctgccagcacccagcaggaaatgcgggctttccctgccttcctgggcactgaggcctccagctcaggcaatggctcctggctggagctgatgcccctgactgctgtgagcgtgcacctgctgacaggtaatgggacagaggtgccgctctcaggccccattcacctgtccctgcccgtgccctccgagactcgtgccctcaccgtgggcaccagcattccagcctggagatttgaccccaagagtgggctgtgggtgcgcaatggcactggtgtaatccggaaggaaggccggcagctctactggaccttcgtctccccccagctggggtactgggtggccgccatggcctcccccacggctgggctggtcaccatcacgtcgggcatccaggacatcggcacctaccacaccatcttcttgctcaccatcctggcagccctggccctgctggtgcttatcctgctgtgtctgctcatctactactgccggaggcgctgcctgaagccgaggcaacagcaccgcaagctgcagctctcggggccctctgacggtaacaaacgagaccaggccacctcgatgtcccagctccacctcatctgtgggggacccctggaacccgccccgtcgggggaccccgaggctccgcctccaggccccctccactcggccttctccagctcccgggacttggcctcctcccgggatgacttcttccgcaccaagccgcgctctgccagccgcccggccgccgagccttcgggtgcccgcgggggcgagagcgccgggctcaagggcgctcgctcggccgagggccccggcgggctggagcccggcctagaggagcaccggcgggggccctcgggggctgcggccttcctgcacgagccgccctcgccgccgccgcccttcgaccactacctgggccacaagggggcggccgagggcaagacccccgacttcctgctgtcgcagtcggtggaccagctggcgcggccgccgtcgctgggccaggcggggcagctcatcttctgcggctccatcgaccacctcaaggacaacgtctaccgcaacgtcatgcccaccctggtgatccccgcgcactacgtgcgcctcggcggcgaggcgggcgccgccggcgtgggcgacgagccggccccgccggagggcacggcacccggcccggcgcgcgcttttccccagcccgacccccagcgcccgcagatgccgggccactcgggcccggggggcgagggcggcgggggcggcggcgagggctggggggccgggcgcgcggcgcccgtcagtggctcagtcaccatccctgtgctattcaacgagtccaccatggcgcagctcaacggggagctgcaggccctgaccgagaagaagctgctggaactgggcgtgaagccgcacccgcgcgcctggttcgtgtccctcgacgggcgctccaactcgcaagtgcgccactcttacatcgacctgcaggcgggcggcggggcacgcagcaccgacgccagcctggactcgggcgtagatgtccacgaggcgcggcccgcgcgccgccggcccgcgagggaggagcgggagcgcgccccgcctgccgcgccgccgccgccgcccgcgcccccgcgcctggcgctcagcgaggacacggagcccagcagcagcgagagccgcacgggcctctgctctccggaggacaactcgctgacgccgctgctggacgaggtggcggcgcccgagggccgggcggccacggtaccccgggggcggggccgcagccgcggggacagctcccgcagcagcgccagcgagctgcggcgcgactcgctcaccagcccggaggacgagctgggggcggaggtgggcgacgaggcgggagacaagaagagcccgtggcagcggcgggaggagcggccgctgatggtgttcaacgtcaagtagcgcccgcgcagggcctggcaccgcccctcccgcgcgggcccgcacccagggtgcgcgccccgggggcccgcgggggccctcgcgcgtagctcccagccccaggccggagaggggcccaggggccttggagctgttccgtggttggtgctgggtcgtgtcttgcaagggaccctgtgtctgcctccaagccggggaggagggggggtccagacccccacggggaggtgccggggaggagggctggggggaagcagtgcctgtgtagacgtggctgtacatagaaagctctattgtgggaaagcaggaggggtgacccagcctcagctgctagtgtgagggctgggaagggagggggcgttctttgtggacccctgggaggggagggggtgctgcttgctgactagcccatctctgggctacgatgtcacagggctggtggctgggacagctctggggactagggggtaatgtgatacagccgatgtgggcagcagcaaatataaaactggtgaggtt

SEQ ID NO: 2207 - DNA, 1396 bp, Homo sapiens
agattgcgcgagggggagcgagcgagcgggcgctgccaggagcccgcagccctggcgcccgccgccgcccggagccccgcaatatgccgccgcggccctctggctctaggccatggcgaggctctgccggcgtgtcccctgcaccctgcttctcggcctggccgtggtgctgctgaaagcgcggctggtccccgcggccgccagagcggaactcagccgctccgacctcagcctcatccaacagcagcagcagcagcagcaacaacaacaacaacagcaaaagcagctggaggaggctgaggaggagaggacagaggtgcctggggcaacctccaccttgacggttccagtgtctgtatttatgttgaaagtccaggtgaatgacatcatcagtcgtcagtacctgagccaagcagttgtagaagtgtttgtaaactacacgaagacaaattccacagtaactaaaagcaatggagcagtgctgataaaagtaccctacaaattaggacttagtttaactattattgcttacaaagatggctacgtgttgacccctctgccttggaaaaccagaagaatgccaatatattcatcagttacactttcactgttcccgcaaagccaagcaaatatatggctatttgaagacactgttttaattactggaaaattagctgatgccaagtctcaaccaagtgttcagttttcaaaagccttaattaaacttcctgacaaccatcatattagcaacgttactggctatcttacagttctacaacagtttttgaaagtggacaattttctgcatacaactggaattactctcaataaaccaggttttgaaaacattgaattgactcctcttgctgcaatatgtgtgaaaatatattctggaggaaaagaactaaaggtcaatggctctattcaagtttctcttcctcttctacgtctgaatgatataagtgcaggggatcgcatacctgcttggacatttgatatgaacacaggtgcttgggtaaatcatggtcggggaatggtcaaggaacataacaatcatttaatctggacatatgatgcaccacatttggggtactggatagcagctccacttccaggaactagaggttcaggtataaatgaagattccaaggacataactgcctaccacacagtgtttcttacagccatattaggaggaacaatagtcattgtcattggattttttgctgtactactttgttattgcagggacaagtgtggtactccacagaaaagagaaagaaatatcactaaacttgaggtcctcaagagagaccagacaacttcaacaacacacataaatcatatcagaaacagaagaaagagtttccatggtaaaaactcgggacgattttaa

SEQ ID NO: 2208 - DNA, 5819 bp, Homo sapiens
acatgcgcgaggatgcgaactccccttccctcctcctccgccccctccgcctcccgggcctcttcctcctgccggtgagggagtgcttggcagattgcgcgagggggagcgagcgagcgggcgctgccaggagcccgcagccctggcgcccgccgccgcccggagccccgcaatatgccgccgcggccctctggctctaggccatggcgaggctctgccggcgtgtcccctgcaccctgcttctcggcctggccgtggtgctgctgaaagcgcggctggtccccgcggccgccagagcggaactcagccgctccgacctcagcctcatccaacagcagcagcagcagcagcaacaacaacaacaacagcaaaagcagctggaggaggctgaggaggagaggacagaggtgcctggggcaacctccaccttgacggttccagtgtctgtatttatgttgaaagtccaggtgaatgacatcatcagtcgtcagtacctgagccaagcagttgtagaagtgtttgtaaactacacgaagacaaattccacagtaactaaaagcaatggagcagtgctgataaaagtaccctacaaattaggacttagtttaactattattgcttacaaagatggctacgtgttgacccctctgccttggaaaaccagaagaatgccaatatattcatcagttacactttcactgttcccgcaaagccaagcaaatatatggctatttgaagacactgttttaattactggaaaattagctgatgccaagtctcaaccaagtgttcagttttcaaaagccttaattaaacttcctgacaaccatcatattagcaacgttactggctatcttacagttctacaacagtttttgaaagtggacaattttctgcatacaactggaattactctcaataaaccaggttttgaaaacattgaattgactcctcttgctgcaatatgtgtgaaaatatattctggaggaaaagaactaaaggtcaatggctctattcaagtttctcttcctcttctacgtctgaatgatataagtgcaggggatcgcatacctgcttggacatttgatatgaacacaggtgcttgggtaaatcatggtcggggaatggtcaaggaacataacaatcatttaatctggacatatgatgcaccacatttggggtactggatagcagctccacttccaggaactagaggttcaggtataaatgaagattccaaggacataactgcctaccacacagtgtttcttacagccatattaggaggaacaatagtcattgtcattggattttttgctgtactactttgttattgcagggacaagtgtggtactccacagaaaagagaaagaaatatcactaaacttgaggtcctcaagagagaccagacaacttcaacaacacacataaatcatatcagtacagttaaagttgcattaaaagctgaggacaagtcgcagttattcaatgccaaaaactcctcatatagtcctcagaaaaaggaaccatcaaaggcagaaacagaagaaagagtttccatggtaaaaactcgggacgattttaaaatctacaatgaagatgtttcatttctatcagtcaatcaaaataattactcaagaaacccaacacagtctttggagcccaatgtagggtccaaacaacctaaacatattaacaacaatctatcttcatctctaggtgatgctcaagatgaaaagaggtatctcacaggtaatgaggaggcgtatgggcgttcccatattcctgaacagcttatgcatatttacagccaacccattgccatccttcaaacatctgaccttttctccacaccggaacaattacatactgctaagtcagctactttgccaagaaagggacagttagtctatggccaattgatggaaccagtaaatcgagagaactttacgcagaccttgcccaaaatgccaattcattctcatgcacagcccccagatgccagggaagaggatatcatacttgaaggtcaacagagcctgccatcccaggcttcagattggagccgatactcaagcagcttactggaatccgtctctgttcctggaacactaaatgaggctgttgtaatgactccattttcatcggaacttcaaggaatttcagaacagaccctcctggagctgtccaaaggaaagccctccccgcatcccagagcctggtttgtgtctcttgatggaaagccagttgcacaagtgaggcactcctttatagacctgaaaaagggcaagagaacccagagcaatgacaccagtctggactctggggtggacatgaatgagcttcactcaagtagaaagctcgagagggagaaaacattcatcaaaagcatgcatcagcccaagatcctttacttagaagatttagacctaagcagcagtgagagtggaaccaccgtctgttcccctgaggacccagctttaaggcacatcctagatggagggagtggagtgatcatggagcaccctggagaagagtcgccaggaaggaaaagcactgttgaagattttgaagctaatacatcccccactaaaagaaggggcagaccaccactagccaaaagagatagcaagactaacatctggaagaagcgagaggaacgcccactgattcccataaattaactccaatggggattgtgtgtctgctgtctcgtgctgtttattcttgcttcttgttgtaaattgcagtacgaacttaagaaaatgagactgagcaatctcatggttcttggacatgtctcaagcagagtaaatggtaattcagtaatcagagagaaagataccaaggaatgctttttctggcctattcatttatttttgggtgatgaatttacagtatctaagttttcaaaatgtaaaatagcttcaagatgttagttatctgaaaatgttgctcagccagccagtttggccttgactctcttaagaataacagtgaaatatatactcctcaagttgcctccaaaaatgttgcctctaccatggtgactaccccatggaacatttagaaacaaaactgacttcaggcatcatattattttaaatgttactattacgtcttcttctgcctatacttaaaaataacttgataaatgacttggactgatgttactctggagttatcacaaagaaaatgttgtttggtctttaaagagcatgtgtattgtatcatcccaaacgtaaatcctacatttatataagatgggcaagaagctacttggtcattagagagggagacaccagctctttggttgtttttggatataactttacaaaataagtaagatgttaatttagaaatttgagaaattaatgctctaatactgagtttttatttaaaaattattttttcttcccctcaacaatgaagcaagcttagctgtcaagggaaactttttacaaatctgaaaaaaacaatctatgactttggtttaaggctcactgatacttttaggctaaattggttttaatatatttcttctattctaaaaacctgaactcagtcacttaaaggctatgaaatttaaaaaaaaagtcgatgtgaaagtttcttttgaacactaaaataaaatatgtgcagataaaatatacattgatttgtttttcttaaatgttgatgagaagaaaaagagatgccattttcctgaggctcaaaaataccttcaggatagttgtatatccagttattgattttcttaaaagatgtgtaaggaaaacagtttcaatttcaggggaaaagtaaaagtttttccctaagtcacttaaagcctttgcaacttcttttttcagttttgtaagtaatatatctatgttcttttcattatagcaagcattcaatgtgaacaactttttaattaactctgaattaccattcatacatcctaaaaataaaagctcgttattcattaaaatcaactgatcccatttttcttaaaatttccctgaaggcaaatgtctgaagcacctttcccttgtgggggtaaaaatcctaaattgctttatttttcattccctcctattcaacatgggagcagcatagagacccaaaccatgtaaacaagttcagtgaaccaaaacagccacattagcttcagtaaaattatagctagatgtgcaattttttcctccaacttctaacgtgtcaaataaccttcctactgttctgtgttaactgaaagaacataaagaccctaggcaaatatttgctatatattaccccaatccatagaagaaataatgttttgggtaatacctaggcttcctttttttttttttttttttttttttagtgataaggctcataacaattaattagagaaggcttcttattggtcttacacagaaagatacatcaaaagcagcatgactcaaaatgatttggaaaaggttaaagttagtgctctgctgaagtgcctttgatatagacttgcattattagaaggatataacatcttttttaagtgtgcattttctttcagttaaccaaattaaacagatgtgcagttttattaaaaatatagacctagtgtttcatgttggaacaataaatattgcatgtgagtagtatttcttgttttttgaatacagtatatattgataaattgtttatgttggaatgaagttagaaactatatagcaaaacattatattttaagtgtttatttttcccacctttaaataaaaatgtttcatctcagcttggtaatgaaatacacatattggtataagggtataccattcaggtatgccacttattttattcatttttgtgtaagggaaatgagatgatgtatcccaagggcttttctagaactacttgtttgctttcagaataaaaccttattattttttacactgcacatgctgttctcaattggtaattataggcaatttatcttttctaatgatcaaaagagtgtgacttctcatttgtgagtagttcacaaatttcctgttaaaaagctgaaaccatctactttttcttaacccaagtgataataaacaatattcacaactttcttaaatttttaaattgaaaaccaaggttttttcaaatataaacctagatgattttggtcacaaattgttaacatttgtcgatcctttgtatatactttggatatatattaaaggcaaaactatctcttgactaactgatggattcatttactaaagcacagctgtatgtatttttgaatacatattatgatcttgagactttataaatcaatttttatgactttatgcagttgtatagggattatgccctttcagttctatagggattatgcccttttataatacataatataccacagagattacaaatgttgaggaatgaaagcacttctttgctttggcaatcattttcagaccactatgtgtttgaatcctctggtatcaatacgtattatagggttttagagatctgtgggtcaaatgatgtccctcaaaacttcctaaaaaggtgaagctcaaagtcacacattcttataaggcgcatgagtttctcattttcccatgtacgagcattgtaaaggaattcagctgtattaatttctatttcagatctagaattgacattttgccttcttgtttccaggtgtttctattttttgtattctttcagagaaatctcatatttcggtgtatttattgctgttactactatatttactgctgaaaactgtaacaacctgaagatttgtaaaatgttaaacatagttcattaaaaataataaaataaatctaaaatgt

SEQ ID NO: 2209 - DNA, 1052 bp, Homo sapiens
ccgcaaacggcggtccgcagagcggaccaacggagccgaccctcgcaggcttggagccggacgcggcggggcagagcccccgaggctgcagctcgccggaacccgcgggagggcagccgggctgggcggagcgcacagcgccacggaccgaccgcgcaggctctgccggccacttccggtgtcgcgcggcggctcccggcaggaggcagagggcacaccgccagccccaggccaggctgcgagggccgcggacccgagccgggaaggaccttgggcggacgagccgcgcgtcccgcagccatggagcaggacgacccggtcgaggcgctgacggagctgcgcgagcggcggctgggcgcgctggagctgctgcaggcggcggccggctcgggcttggcagcctacgcggtgtgggcgctgctgctccagcccggcttccggcgcgtgccgctgcggctgcaggtgccctacgtcggcgcgagcgcgcggcaggtggagcacgtgttgtcgctgctgcgaggacgccccggaaaaacggtggatctgggctctggcgacggcaggatcgtgctggcggcccacaggtgcggcctccgcccggccgtgggctacgagctgaacccctggctggtggcgctggcgcggctgcacgcctggagggccggctgtgccggcagcgtctgctatcgccgcaaggatctctggaaggtgagcctgagggactgccgcaacgtgtctgtgttcctggcccctagcgtgctcccgctgctggaggacaagctgcggacagagctgcctgctggggcccgcgtggtgtctgggcgcttcccactccccacctggcagcctgtgaccgcggttggcgagggcctggaccgagtatgggcttatgatgttcctgagggtgggcaggctggggaggccgcctcctcgcggatacccatccaggctgcccccggacctagttctgcccccatcccggggggccttatttctcaggccagctgagtattagacacgataaagactctgtgggttctatcctgactcat

SEQ ID NO: 2210 - DNA, 858 bp, Homo sapiens
gcgcggcggctcccggcaggaggcagagggcacaccgccagccccaggccaggctgcgagggccgcggacccgagccgggaaggaccttgggcggacgagccgcgcgtcccgcagccatggagcaggacgacccggtcgaggcgctgacggagctgcgcgagcggcggctgggcgcgctggagctgctgcaggcggcggccggctcgggcttggcagcctacgcggtgtgggcgctgctgctccagcccggcttccggcgcgtgccgctgcggctgcaggtgccctacgtcggcgcgagcgcgcggcaggtggagcacgtgttgtcgctgctgcgaggacgccccggaaaaacggtggatctgggctctggcgacggcaggatcgtgctggcggcccacaggtgcggcctccgcccggccgtgggctacgagctgaacccctggctggtggcgctggcgcggctgcacgcctggagggccggctgtgccggcagcgtctgctatcgccgcaaggatctctggaaggtgagcctgagggactgccgcaacgtgtctgtgttcctggcccctagcgtgctcccgctgctggaggacaagctgcggacagagctgcctgctggggcccgcgtggtgtctgggcgcttcccactccccacctggcagcctgtgaccgcggttggcgagggcctggaccgagtatgggcttatgatgttcctgagggtgggcaggctggggaggccgcctcctcgcggatacccatccaggctgcccccggacctagttctgcccccatcccggggggccttatttctcaggccagctgagtattagacacgataaagactctgtgggttcta

SEQ ID NO: 2211 - DNA, 1423 bp, Homo sapiens
tggaaatctcgcgatggagggaggaggaggtatacccctagaaacacttaaagaagaaagtcagtcaagacatgttctacctgcaagttttgaagtcaacagtttgcagaaaagcaactgggggttcttacttactgggcttgtgggtggcaccctggtggctgtgtacgctgtagccacgccgtttgtaacgccagcccttcgaaaagtctgtttgccgtttgtacctgcaactacgaagcagattgaaaatgttgtgaaaatgttgcgatgccgaagaggatcccttgtggacatcggtagtggggacggacgcattgtcatagcggctgcgaagaaagggttcacagcagttggttatgaattaaacccatggctagtttggtattccagataccgcgcttggcgagaaggtgtgcatggatctgccaaattttatatttcagatttgtggaaggttactttttcgcagtactcgaacgttgttattttcggtgtgcctcagatgatgctgcagttggagaagaaacttgaacgtgaacttgaggatgatgcacgagttattgcttgccggttccctttcccacattggactccagaccacgtcacgggggaggggatagacacagtgtgggcatatgatgcaagcacttttagaggccgtgaaaagaggccctgtacatcgatgcatttccagctgcccattcaagcataaacttgactgggagtgtttttctgaaatattgtagtcttccctgatcttgtagagacttacagctgtgtccttagcaaaggagcataattgtctttggtttggaatgagaaattactattactttccttaactgttggagaaaacaaacgaagaaaaacaggtagatttaaaatctgcttttgatgctattttcttaaaaattgtacttactgcctttccatgcacctggatgcatgaaaagatgaataagtgatggtcatggttatgggtaggaaaataagatgccaatagctcttcacattataaacaatatggcttaatgcctcgataaggagaaatgatttttaaagacagtatatattaccaactgtttgtagtatcctataactttgttcatacttaagttgtatctctttcctttttgtacttcatggcaaaattaattttctaaaggattcagagaggcgtttatattttataacatttattagaaataatttgttccaccactagattactgtattttatggaatctaagctgtatatgtgtacatttgtatacatgtatgtgtaaatgtaagcctgacgtgggttcagattccagttttgtcatcagcaagaggcctcggacccatgacttactgcctctgagccttggctttctgtgtatctctgccactgggataatggtacacataacagtggagt

SEQ ID NO: 2212 - DNA, 1356 bp, Homo sapiens
aagttagcaaccgaaggcgtccttagcagcagtggccgctgagatgtacgaacttccggttctccgggcagctgccactgctgtagcttctgccacctgccacgaccgggcctctccctggcgtttggtcacctctgcttcattctccaccgcgcctatggtccctcttggagccagcgtggcgggcctggcggctcccgggtggtgagagagcggtccgggaacgatgaaggcctcgcagtgctgctgctgtctcagccacctcttggcttccgtcctcctcctgctgttgctgcctgaactaagcgggcccctggcagtcctgctgcaggcagccgaggccgcgccaggtcttgggcctcctgaccctagaccacggacattaccgccgctgccaccgggccctacccctgcccagcagccgggccgtggtctggctgaagctgcggggccgcggggctccgagggaggcaatggcagcaaccctgtggccgggcttgagacggacgatcacggagggaaggccggggaaggctcggtgggtggcggccttgctgtgagccccaaccctggcgacaagcccatgacccagcgggccctgaccgtgttgatggtggtgagcggcgcggtgctggtgtacttcgtggtcaggacggtcaggatgagaagaagaaaccgaaagactaggagatatggagttttggacactaacatagaaaatatggaattgacacctttagaacaggatgatgaggatgatgacaacacgttgtttgatgccaatcatcctcgaagataagaatgtgccttttgatgaaagaactttatctttctacaatgaagagtggaatttctatgtttaaggaataagaagccactatatcaatgttgggggggtatttaagttacatatattttaacaacctttaatttgctgttgcaataaataccgtatccttttattatatctttatatgtatagaagtactctgttaatgggctcagagatgttggggataaagtatactgtaataatttatctgtttgaaaattactataaaacggtgttttctgatcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattctcttaaa

SEQ ID NO: 2213 - DNA, 2792 bp, Homo sapiens
ttcaccacggggtctcaagtcccgaggaattggggtcgcgggcgagcggagcgcagccgggacccaggccgggtggcctgccccgcccacgtggggccgcggcccgtcgaatgactccttgcaacgtgttggtggtggcggcggcggtggcgcgggctcttccgggcgccgcagcttcctgccaagcaccgcgcagccgcctccgccgcaggatcccccggtgcaggcctccgtgctggtgcggatcctggagctcagccgcgcgcgccctgcccgatcctgtgccgacccaccgcactatgcgcgccgtgccgctgcccgccccgctcctgccgctgctgctgctcgcgctcctggccgctcccgccgcccgcgccagcagagccgagtccgtctccgcgccgtggcccgaacccgagcgcgagtcgcggccaccgcccggcccggggcccgggaacaccacccggtttgggtctggggcggcgggcggcagcggcagctccagctccaacagcagtggcgacgccttggtgacccgcatttccatcctcctccgcgacctacccaccctcaaggcagccgtgatcgtggcgttcgcctttaccaccctcctcatcgcctgcctgctgctgcgcgtcttcaggtcgggaaagaggttaaagaagacacgcaagtatgatatcatcaccactccagcagagcgagtggaaatggcgccactaaatgaagaggatgatgaagatgaggactccacagtattcgacatcaaatacaggtaaaacctgtttcccagcctggtggcatcctgtggaaagttggtcagctgcaacctggggtgtgaaggactggacctggaagccctcttgcgtcggaggtgttgaaaccaaaacgaacgttatgtataaaaccccagctccatcgtgcgtgtcaggcatctgctcagactgtcactggcaagctcgtttccacgtcaccacaatggagttgcttctgccaccctttgggcatccctttaaagtgccccctacttctactccccatgtaagaggctttgtgccttgctaaggagcaaagggtagaaacatgttgattttaaagaagtttttttaagacaattgttgacaatagtaaaagagatcaggaggatcaagaatctaaaacaagcctgaaggatgtccaactgtgtatttagaatttccgacattcttctctactggatctacacattggaccccatctgatcctttgctgcttttttggcttggtcaggtcctggcctcattttggcgttacctgtgtcagagttcaaggtggatgtgcttagagctggtcagccccttccagacctggacacgtctgtggctccttttctttcttcctttttttttttttttaaaaaaaaaaaaggttcagcagaaatcagcgtggctagttcacaaagaatttccagtatcagggaaaaactgtgcgtgtgtgtgtgtgtgtgtgtgcacgtgtgtgcgtgtgcacgtgtgtgatacctataaaacagtttctccttctctgaagggaaaggaaagtgctaggcagcctgtgattagcaacattctttgtgcttttttgttgttcctctgctctgtcacagttctacgttgtttgccttagaaatgtaatttttaaaaaccattttaaaaatgaacggtgatttggctggctggaaaaaatcacactgtcaggggactatatttgaagtcagtctagacggggctggactaggaacccacctggacccaggagaccccacaggacccaggaggtccctgccggaaggcagaggttcaggtgagagtggctcacctctgagctggtgaagtgaggacttgcctgtgacatgacccagggatctgctgctggcttctggagacagggccttgggctgacttctcaggttgattgaggcctcctgactagcggtgttcccaggctagaggtgattggctgcaacaaagatgcttctattagtctattagcagtgccttcgggaccctgggattttgctctctctagaaaggtgttttttatttttttattttttatctcccccttttttcctggctttgctccagggtttgtgtatttgcctgtttattgtcctgctctttttttttttggatgaaaactccagcctttcctgactcacctccatcttcggttcttcagttttctgagaagagttgggatatgtgggaaggggcatgggagctcggcagcctccgcctgccaggaaggcagtttcgcctctgcaggaaagagcagagcccgtgggaagccctgggtgagggtggcgcagccggcccagcacgcatggtattgccagccacggggggcctgcgtgtagtctctgctccctgcatttcaccttctttgttgactttccttctctgttttcccccatctgtttgccagaggggtgggactggcaacagaacagccgtggctgctttatctctcctctccacggtgtactcaggcctgagtggtgactcacgggagcctggccacctcgcagctgttcgccccctcaacctttgaactggaactgctggctcacacagggttttcgacaactgcagctgaatctcatggaaaagctggattcctctgccttacgcagaaacacccgggctccatctgccaggtgcttgccactggtcctggcagaaatggcggctgctgaaagtgaccttccaaatccttggtggcacttcagcgccacaggctctccaataaaaaccctttacacacaaaccatg

SEQ ID NO: 2214 - DNA, 1815 bp, Homo sapiens
agcataacctgtttgtgaaactgcaaaaaggttgacatggctgaagcagaagatgggttggtactgaatggttgggagagatatgtagcggctgaccctgaaggacgttgcagcccatgctatggagacctgattttattttgtaagaggtgggcaacccctgaagcattttagtgatgcgaacagatgtgtctgttaccaagcaaagccagttaaagaaggtcacagaggaggaatgatcacaaagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgtttttttttttttttttaattggatttcaaagaaaagaatggaaatgagaggtaaggattaaagccaaagttaggatgggaattaaaaaaataaacattacataaaatctt

SEQ ID NO: 2215 - DNA, 1802 bp, Homo sapiens
cggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgtttttttttttttttttaattggatttcaaagaaaagaatggaaatgagaggtaaggattaaagccaaagttaggatgggaattaaaaaaataaacattacataaaatctt

SEQ ID NO: 2216 - DNA, 777 bp, Homo sapiens
cgggacaggaatgagaggatggatgctggcaggggcttggagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaaccca

SEQ ID NO: 2217 - DNA, 1747 bp, Homo sapiens
ctgactcgggctcctgcagcttctgcggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaagtgcaggtaggtagatcgctgaccacatttgctcatttctggattattcattcaaaggaagcactatgagtcaatcattgggcacagagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctc

SEQ ID NO: 2218 - DNA, 569 bp, Homo sapiens
gagtagctgaatacaggctcaaagcaggcgacgggacaggaatgagaggatggatgctggcaggggcttggagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcc

SEQ ID NO: 2219 - DNA, 434 bp, Homo sapiens
gaacccgatgggctgtgcctcaaaggtgaaccagggagaatcaaataaagagttccagaagtgaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgc

SEQ ID NO: 2220 - DNA, 1080 bp, Homo sapiens
aaagcggaggtgaggccggactgaggctcttacagtggtccctgctggcccttggtgacgggtcgcgtcagttccgacccggacccgtacgctgctgcgctgacgtggctcctggaagcagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctgtcttctctgtgagttgctcagcagcagctttattacctgtatggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggcggtggttattatgggtgtggtgctacaaggtgccaacctgtatggttacatcaggtgtaaggtgcgcagcagaaagcatttaaccagcatggctacttcatattttggaaagcagtttttaagacaagtaagtgttttctggatgtgatcagtgactaatgcaattatttctaactttcatagtttaatttttatgaaacgctcctgaacagaagttttaaaggcatatagttgtataaatataatgataaagatgttgtaattgctctttgggggtgttcaagacagtctggaagtgtattgtcagtatcctaaaattattttaaagccaggaaggataaactatcattgataataacttattttttaaaaattacttttaagttcagttgtttttcatcaattatgggagctttaagtgaatgcccttgcagaatgtatgttgtatgtttttatttttattttttgagacagagt

SEQ ID NO: 2221 - DNA, 3339 bp, Homo sapiens
ccaggccgttgcctccctgccgccgctttctctcctgggcgcgtccccggcgagccgagccccctccccagcctgcgactgcgccttaggccccgagcgccccgccccacccgagaagctgcgctgaggctgccccacagggcgcaggccccgaccctcagcgtccaccgtctgctgcctacatccgcccgcccggcgtccgaccccttcagcggcgacgggcggagctggagccccgggcctgggcgccaggtgggctcctgggagggtgatgaagcaggccctggtggacgataccgaggatgtgtccctggactttggaaacgaggaggagctggcctttaggaaagccaagatcagacaccccttggccacctttttccacctgtttttccgagtgagtgccatcgtcacctacgtgagctgcgactggttcagcaagagctttgtgggctgttttgtcatggtgctgctcctcctgtccctggacttctggtctgtgaagaatgtaaccggaagactcctggtgggccttcgatggtggaaccagatagatgaagatgggaagagccactggatctttgaagccaggaaggtctctccgaatagcattgctgccacagaagctgaagcacgaatcttctggctgggcctcataatctgccccatgatatggattgtgtttttttttagcaccttattttccttgaagctaaagtggctggctctggtggttgctgggatctctctccaagctgcaaacctgtatggctacatcctttgtaagatgggaggcaacagtgacattggcaaggtcacagccagtttcctgtcccagacagtgttccagacggcctgcccaggtgactttcagaagcctggcctcgaggggctggagattcaccagcattaggaactgatgaggttctcttcttttgactgatggagattacaaaactcttggattcctggaaaacaagacgacaggcatagagtgctaatggcttgtctaccccttgacagccctgtcctgtgctggggagggctgtgttttgacaggggtggaatcctctggctagttccataaaaagacctgtgtctgtgatgccctgagtctttgaaagtgaccggaatacctcacactacccatcttgctcataaccagtggctgcggccttcctcggaccatctatagatggaggattctgggaatgctgtttccttacccttgacatcattcttctaggcaagtaaaacccagccacaaactcagagaccacagctttaacaaacactgacacctctgccctaactctggggcctctgatggctgccactggctgaatgtggcctgcacgtgggtttggtctggctcaacaaagtttttatttttattttttatttttttgagacacggtctcacgctgttgcccaggctggagtgcagtggcgcgatctcgccttactgcagcctccgcctcccaggttcaagcgattctcctgcctcagcctcctgagtagctgggactacaggcatgcgccaccacacccggctaattttcatatttttagtagagacagtgtttctccatgttagccaggctggtcttgaactcctgaccagcctcaagtgatctgcctgcctccttcacccaaagtgctgggattccaggtgtgagccactgcacctggccttttttttttttatcagttacttttaaaaatgaattactttatccctttattgggatgtatttcctaagccataaatttcaccctcaccatgttttttaaactatgaattaattcacaatactcacacattgagagatttctcatggactcctggcttcctcggctatgggggccactctgtggtcatcacagaccccaccacccacctgtccttccacacccctggctcctttatgttgcttcctgccccacaggcatctgcatttagtactcatggaaatacttactctgaattatacttctgtaggctaacgtggctggggaatctggggcgtcaatgaaaaaagactggcctttgtcacaattcttaccttaaaaaagaaacaaacggaagacaattcagtccaagaggaaaacagaatggccacaagatcttggggctctttccgtgctggtgacaatgggaagatcttgagcccgcttcactcgtaatgaagaacaaagtagaaaagaccagtggggtctcagggaccttccttccagcagggtccccagccagcatttcagcgtggctaaataatcaggtggtgtacagaaaatgcaggttccagggccctacagagaactgattcagcagcttccacatgggcccaggagtctgcattttaagagattagcttttgagtgaaaggatcatgaatgcacatggttaaaaaaagtacagaatgcaaaaggatatggcataaaaggccaagtccgaaaagggctactagtgttctaggtgtctttccagaaagattatgcgcatataaatgtgcacacttgcatgtgtgcgcacacacatacacacactctcatatacctaaaatacgaatgggagcacatgacacacacattctgcctgctgctttgtctgtgtataattttatcttccaggtcatctgtgctggtgtctatcagtctgctagtctttccccgccatgtggccattgttccagtcccctcctatgcacacccaggtttctctaggaccatgttatcccagagccaggtggacaggacacaaggggctaggggtcaatgggggtgttctcgcctccagtctgccctgccagcccccagtcgtgggtggacctgccatcagcttgctctgcccactccccaggcctgagctgctggcgaaacaggcaagtgactgcactgcccatggccggtcaccagcctcaggtgaaccccaggaggggttcctacctagcactcatcatttcctcaacttcactactgtgtcgccctgtgggacagggaagtccaagtcggggaagaagcctgtggggaggggttggtgggagatggggagcccatatggcccagtgagtcaggaaaatagggtccagaggcagggaacataaggccaattcgcacttgagccataacaggaaatgtcctctccataggacgtatgccgtaaatgactttgtaactttacttcatccttttcgtttatatagggcgtacctcaagtagagggtatttaaacacaaaaactctgtaatggggcctttgagcccctattctcaggcccgttctcctcccacaccgtggagttgactttcattttcaataaatcccttccttccttccttt

SEQ ID NO: 2222 - DNA, 1223 bp, Homo sapiens
ccaccgtctgctgcctacatccgcccgcccggcgtccgaccccttcagcggcgacgggcggagctggagccccgggcctgggcgccaggtgggctcctgggagggtgatgaagcaggccctggtggacgataccgaggatgtgtccctggactttggaaacgaggaggagctggcctttaggaaagccaagatcagagaccgggtctcaaaactcctagcctcagtgatcctcctgccttggcctcccaaagtgctgggattaaagaatgtaaccggaagactcctggtgggccttcgatggtggaaccagatagatgaagatgggaagagccactggatctttgaagccaggaaggtctctccgaatagcattgctgccacagaagctgaagcacgaatcttctggctgggcctcataatctgccccatgatatggattgtgtttttttttagcaccttattttccttgaagctaaagtggctggctctggtggttgctgggatctctctccaagctgcaaacctgtatggctacatcctttgtaagatgggaggcaacagtgacattggcaaggtcacagccagtttcctgtcccagacagtgttccagacggcctgcccaggtgactttcagaagcctggcctcgaggggctggagattcaccagcattagatgtttcccctgacaaacgtcctgcccaccaatcccatctcggcagagctgaactgtggcagaggtgcaggctggcaggaatggatgtgccctgggctgctgcaagctcctgtccccaatcacatccattcatgcagcccaactgcctccaggggcctcagagggcagctctcatcaccacttccggccactgcaaaagctgcctgggaaagcagaaatagtttgcagagcagccttccgatcgtttcctcatccatgagagcaagatcttgctcgcctggcagccccacgcgccctcaccttgcacttaggacagatgaagccactcatgttctccaccaccccgatgatgggcagcttcaccttgcggcagaagttgatttctttccggacatcctggagtgacacctcctacgaaggtgaaaagaccagtgattccagcatcaaagtgcgagaaagggaatgtctgtgcaaccgaggggatggctgcaatgcagtggatctgcgatcataaagccttagaggtttctgccctgatagggtttggct

SEQ ID NO: 2223 - DNA, 1853 bp, Homo sapiens
ttggtgacgggtcgcctcagttccgacccggacccgtacgctgctgcgctgacgtggctcccggaagtagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgggttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgtccagtactgtgggtgatatttgcttttagtgcactcttctccttcagagtaaagtggttggcggtggttatcatgggtgtggtgctacaaggtgccaacctgtatggttacatcaggtgtaaggtgcgcagcagaaagcatttaaccagcatggctacttcatattttggaaagcagtttttaagacaaaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaaaagtagttttcatattaagtttttatttcctttccagcagttggggctagaaagtatgtgttggcactagaaacattgtcaagatttgttctgtggtgtaggtatgcacattccataggtatgcacacggccatgtaatatcagtatatcccaagttaatgaaagtgttcatttacataggtaatggagacctttgcattttgatccatagaacataggaggatgttcttagtctgtctcaaagctctatatgtttacatattatttctgtagattgttttcaggagaaagttttgcttctatggtaagagtgagcactttggcttatgtataagttagaaataattgttagtttttaatatgcacttcgtggggaaatttcttagacgtatgcaagcaagtgaaaacaattagggccagtggtattaactactttataaaattttatttttgtttgtaagaagtcatctatttaaggcccagttaatataagtggaatcatcatagtttaaggaatacccagagattgctgctgttctatttattttacagaaaggatagctagattgaaagctcttcagtggaccttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaactgtaaattaaaccaatctacaaactattgtaggcatctgtaaattctgttgtaggtattataaactttgttgaagtcttaatcagcagattatgttgtgaatatatttgtacattgttaaaatagtttttaagattatttgtttaattgaataagtgtcttattggagtgatagctttgaaggtgcaaaactttatatttgtataaaattctactatttacaaggca

SEQ ID NO: 2224 - DNA, 1527 bp, Homo sapiens
gctggcccttggtgacgggtcgcgtcagttccgacccggacccgtacgctgctgcgctgacgtggctcctggaagcagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctgtcttctctgtgagttgctcagcagcagctttattacctgtatggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctgagacggtctcgccacattgcccagactggtctgaaagtcttgggctcaagagatcctcccgcttccgccttccaaagcgctgggataacaggcgtgagccgctgcccgggccatccctcgaggaagtttcatcaggtagacattaattctttcacgaggatcacggatcgagctctttactggaaacctgcgccccgccttagttctccacctcttcgtgcggctccaggcaactgccaacagatggcgcccgcccgcctatttctctccttgcggctttgggcctggaggggaggtggggagagtcccaatagcagaggaactggtgagcccgggccaaaatttcatctggcatccggaatgcattaaaaacaacccacaaatctgaagctcctcgcaggagagagagagagagagagagaggagagagaggagagaggagagagggagggaagagagtgacggagaaggagagaaagagacgggagagaggagagagaaagagagagagaggagagagagaaagaacgaacgaacagggaacttgtaaaactaaggggaaaagggcagaagagaggcagcagcgtggtccctgcaagcgtccgctttcctggccaagcagcccccagcacgcctgctttgtggggcagggccatgcggccccgaggaaggatgcggtgagccagagggttccagacaaaggaggggatccccaaggctctgggccagccagtccctgttttactggcaccacggtccctcctaggcgaggacgaagagggaaggggtggagacctccaccttctctgcgtgtggctgcgtccctttacagaatgacaggcccttacttccgagggcggggactaatgtgtaaggcttaacagatccaattccagaaattatctgtgtttttttcaatcaccctcttgtgcccccccaccccccattaaatttcatcttttatctttt

SEQ ID NO: 2225 - DNA, 4226 bp, Homo sapiens
gctcgccccgcccccgctcgccccgcccctggatttgctccctcaaagcggaggtgaggccggactgaggctcttacagtggtccctgctggcccttggtgacgggtcgcgtcagttccgacccggacccgtacgctgctgcgctgacgtggctcctggaagcagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctgtcttctctgtgagttgctcagcagcagctttattacctgtatggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggcggtggttattatgggtgtggtgctacaaggtgccaacctgtatggttacatcaggtgtaaggtgcgcagcagaaagcatttaaccagcatggctacttcatattttggaaagcagtttttaagacaagtaagtgttttctggatgtgatcagtgactaatgcaattatttctaactttcatagtttaatttttatgaaacgctcctgaacagaagttttaaaggcatatagttgtataaatataatgataaagatgttgtaattgctctttgggggtgttcaagacagtctggaagtgtattgtcagtatcctaaaattattttaaagccaggaaggataaactatcattgataataacttattttttaaaaattacttttaagttcagttgtttttcatcaattatgggagctttaagtgaatgcccttgcagaatgtatgttgtatgtttttatttttattttttgagacagagttttgctctgtcgcccaggctggagtgcagtggtgcaatctcggctcactgcaacctctgccccccgggttcatgtgattctcctgcctcagccttatgagtagctgggattacaggcgcatgccaccacgcccagctaattttttgtattttcagtagagatgggatttcatcatgttagccaggatggtctccatctcatgaccttgtgatctgcccacctcagcctcccaaagtgctgggattacaggcgtgagccaccgtgcccagcctgtatgttgtatggttttagggagaacagttgaatcacaagaagaccataacatttgtactcagatgtttttttccccctagaacataaggattttactataatacctcaacatcagggttttcagcaggatgagtagtagtcataggtaaataattattggttaaatctcttgggaaaagtgactaggtctttttttttttttttcttgagatggagtcttgctctgtcgcccaggctggagtgcagtggcgtgatctcggcttactgcaagctccgcctcccgggttcacgccattctcctgcatcagcctcccgagtagctgggactacaggcgccgccaccacgcctggcttttttgtatttttagtagagacggggtttcaccgtgttagccaggatggtctcgatctcctgacctcgtgatccgcctgcctccgcctcccaaagtgctgggattacaggcgtgagccacggcgcctggccgtgactaggtctttatatgagtaataccttgcatttggttagtacagtaggttgggcaagtgatattatgtaggacagggattcttaaactcgaacatacatgagaatcacctagagggcacaagattgctgggttccacctccagactccttattcagtagatctgggggtggagtctcataatttgcatttctcccaagtttctgggtggtactgagggcactggtccagggattacattttagataactaaagccccgagaaattaaattatttacttaagattatacagctaatagtggtacaaagctagatcttaaacccagccctctgtactcaaaatttattgttctttttattctactgtacagtttctctcacagaagatgaaaagtagagaaaatgaatattcatgtagggacatgatcatctcattctgaaggatttttgcatggctccaatatacctttactgtggtccaccttagggtaactttcatgtatgtgcttattaggtttttttcgttagaattttcagtgtttctgaaggtggggaggaacatggaatacaggtgaaattaaaccttaaacctggcataacatggatagggttagtgtcttacatggtatccggcgtctgctcaaatgagacaaactggacagctgggtggatgatggtatccatggatttacttcattagcgcatgtctacttttttatttatttattttttttgagacagagtctcactctgtttgcccaggctggagtgcagtggcgcgatctcggctcactgcaaactccacctcccgggttcatactattcttctgcctcagcctcccgagtagctgggattgcaggcgcccgccaccacgcctggctaattttttgtatttttagtagagacggggtttcactgtgttagccaggagggtctcgatctcctgacctcatgatccaccctcctcggcctcccaaagtgctgggattacaggtgtaagccacggcgcccagcctagcatgtctactttttaatgtgattgggccattgtatgtaaggtaatgctctgcttagaaatatagaatgttttcctaggcctaggccccaagtccatggtgtgtgaagtgaaataactttgatgttaaggagttctttttttgtcttttgcggaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaaaagtagttttcatattaagtttttatttcctttccagcagttggggctagaaagtatatgttggcactagaaacattgttaagatttgttctgtggtgtaggtatgcacattccataggtatgcacacggccatgtaatacctgtatatcccaagttaatgaaagtgttcatttacacagataatggagacctttgcattttgatccatagaacataggaggatgttcttagtctgtctcaaagctctatatgtttacatattatttctgtagattgttttcaggagaaagttttgcttctatggtaagagtgagcactttggcttatgtataagttagaaataattgttagtttttaatatgtacttcatggggaaatttcttagacgtatgcaagcaagtgaaaacaattagggccagtggtattaactactttataaaattttatttttgtttgtaagaagttatctacttaaggcccagttaatataagtggaatcatcatagtttaaggaatacccagagattgctgctattctatttattttacagaaaggatagctagattgaaagttcttcagtggaccttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaactgtaaattaaaccaatctacaaactattgtaggcatctgtaaattctgttgtaggtattataaactttgttgaagtcttaatcagcagattatgttgtgaatatatttgtacattgttaaaatagtttttaagattatttgtttaattgaataagtgtcttattggagtgatagctttgaaggtgcaaaactttatatttgtataaaattctactatttacaaggc

SEQ ID NO: 2226 - DNA, 1005 bp, Homo sapiens; identical to SEQ ID NO: 2138

SEQ ID NO: 2227 - DNA, 1184 bp, Homo sapiens
tcacaatgttcggggtggcaccagcccactgccacagccccagtccaccatgccacccatgctgtggctgctgctccactttgctgccccggcactggggttctacttttccatcagctgccccagtggtaagcagtgccaacaggccctactctcaggcaatgatattctcctgtattgcaactcctcgggggcgcactggtactatttattcacacaaggcaagaagggcaggctcaccagcctcaccaatatttccaatatggaaataatgcccgagggcagccttctcattaaagatccattgccctcccagacgggcctctaccactgctggaacaagaatggccgccaagtggtgcagtatgaaattgactttcaggatgtcaccaccctgcatataacacacaaggacctgggtcagaggcccctgcagaacgagaccctgcatttgggcagcaaacagctcatttttacctggtgggagccctggcaggactgcaaccgctgtgaggagccgggcgagtgtaaacgcctggggtaccgctacattgaggagcctctggaggaagccatgccctgctggctctatctgggagaggtgctggtgtggtctagccgcttgcggcctgagctgcaggtggaagcctgccacgtccagtgcaccaataacacacagttaagggtggattacgtcatttttgacaacttcaggctcgatgagaagacagaatttgtgtggctcgactgtcccttaggatccatgtacaggcccgtcaactggcgtgccaacgacacccccctgacgtgggagagccagctctccggccaggacttcaccacctttctggacccctccaccggcggcaggcagctgcaggttttccagccggccgtctacaagtgcttcgtgcagcaggagctcgtggcccagttcaaacccgccgccagtctggagacgctggaggctcagtggagagagaacgatgcccagtggcgggaggcaaggaaggccctgcggggcagggcggactccgtgctcaaggggctgaagctggtgctgctcgtggtcaccgtcctggccctgctgggggcgctgctcaagtgcatccacccttccccgggcaggagaagcacacaggtgctggtggtgaaataaagcgagcccccggtgcacaagcgga

SEQ ID NO: 2228 - DNA, 4705 bp, Homo sapiens
atgcctccggccggcggcccccgagcgccgcgtcccgccgcgctgccccgcagcctgtcccgcctgcgcgagtgcccgggccgctcccgcatcgtgctggcgctcggggccacgcagatggcgctcggatgcctcatcgtggcagtcagcttcgccgcgctggcgctcaccacctcggcccgcgtccgccactcctgccccttctgggcaggcttctcggtgctgctgtcgggactcataggtgtcgtctcctggaagaggcctctctcccttgtgataacctttttcatgctgctttctgcagtgtgtgtaatgctgaatttggctggttcaattctctcttgtcagaatgctcagctagtcaactccctagaaggctgccagttgattaagtttgacagtgtggaggtgtgtgtctgctgtgagctgcagcaccagtcgtccggctgcagcaacctcggggagacgctgaagctgaacccgctgcaggagaactgcaacgctgtgaggctgaccttgaaggatctcctcttcagcgtgtgtgccctcaacgtcctgtccactatcgtgtgtgcgctggccacagccatgtgctgtatgcagatggtctcctccgatgtcctgcagatgttccttccgcagaggtcacatcctgccaaccccacctgcgtgactcctcacggcaccgttctccaccagaccctggatttcgacgagttcatccccccactcccgcctccaccctattaccccccagagtacacctgcacaccgtccactgaggcccagaggggcctccacctggactttgctccgtctccattcggcactttgtatgacgtggccatcaatagccccggcctgctctatcctgctgagctcccccctccgtacgaggcggtggtgggccagccccctgccagccaggttacaagtataggtcagcaggtggccgagtccagctccggggacccaaacaccagtgctggcttcagcactccagtaccagctgacagcacaagcctcctggtgtccgagggcactgctacgccaggttccagcccatcccccgatggccctgtgggcgccccagcaccctccgaacctgcccttccccctggccatgtgtctccagaggatcctggcatgggctcacaggtgcagccaggtcccgggcgtgtgtcccgctccaccagcgaccccaccttgtgcacatctagcatggcaggcgatgcctcttcacacaggccgtcgtgtagccaggacctggaagcgggactgtctgaggctgtgcctgggagcgcttccatgtctcgctctgccacggctgcctgtcgggcccagctttcaccagcgggggacccagatacctggaaaactgaccaacggccaacaccagagcccttcccagcgacctccaaagagcggccacgctctttagtggacagcaaggcctatgcggatgccagggttttggtggccaagtttttggaacactcacactgtgccctccccaccgaggcacagcacatggtgggtgccatgcgcttggctgtcaccaacgaggagcgcctcgaggaggaggccgtcttcggcgctgacgttctggaccaggtatgaaggagccacatttctgaccgtggacaccaacgcctggcgccacagatgttcttggcagaagccatcatgcctgacaaagaggccttcaggcccagcttggcggaggataaatgtgggggggacacccaggatgatctgggggcggtgtgggcagggaactgttaccccctctctcgaggggagccgagcagtgtctctttggggattgcatttcctgcctagcccagtaattcggaaagatgactttcacgtccacagtgaactctctggttttatctggcgtgcagcaccttgaactgagcagtgttgcacaaatgtgaatacagcaacaggcgacacttacgtcacctaaagactcaaagtatctccaaaatcagggccttccaaagcaggagtctcccatcccccatttaacttagtgttcagtggacagagggtgacatcgagtcatgaaacattttctcatgtggctcgatggctctatcattaggcgttcatcacgctctggcctatttcctgtgaaaggaaataggtagtgttagcacagatggcagcctgggcccaactttctgtccacagggctattgtgcaaacaaatgtgcagtgcgggcctctgccatagcccggccccccccagggaacaggccggtgttgcgggggttggaggaacccaccatctcctgggccttgagctcggcctccctccgtggggtgccttccccccctcctcttgggccccctttctccaggctcccatcctgtccctggagcagttgtgtgatccgtaacaacaagtgccgattcccagctcctttgtgtctgagctcacttgattgagctcagcgggtcacagttctgcaggagagaggccggtttctctgagaagtagcccctcctgataaagcaggtccctttgacccagagctgacctttccccgggcatgcggcagcagacacacctgcgcaggaggatcataaaccacttacaaacccacacgagaagggaagcagacacccaacgtgctgcttatggagaagcagacacgcccagcttggggacagcctggggaccttggactttcttagcccccatccccttgttttctggtggcatcagtggcagctgctcccaacaatggccgtggaacagcgccatccacgagaactttgtgcagtgatggaaatgcctgttcagggccactagcagccacagcccctgagctgcgttgggtgggccctgcggtgaacaaaacagcctagaggccaaggtctccccagagagcccatgagcctggcatgggggcgcagggggaccagagggtgtcttccactcctgggtgccagggcagggggctcacgctgctgttccctcggctttgtggggcttgtccttgagctcccccaattccctaatgccactgtggccagtgtgctggggagcttctgtgtggctggaagctgggaagggggtgaggttccaatccaggtgcccagagccttcctccagtcctttatccctgccctgggggctgcggtgtgggactccttcagctgtggtcggctgaaaaggcttcgattgctttagagagctgaaaacacataagccaggccttttgatgacaacctgcacttttgcaggagagacgtactagagatgaatttttgagcactttattcagactataaaacaggaaatctctaattttcctcaagtgggggcttttgaattccctcaaggcaagtccctttgcaggtgaaattaattggtggattttcagaatggccgccctggagccgagcttcagccacgcctgacgccctggcctctgaatctccactgtctctgaggtgcgctggggccacgccgcaggggtttcacctgcttgggggggtccacactagggcttgggggttcacacagcattgtccctgggctgagcccttgggtgggctagagctgcagtcctcagacatggctgcaattccagcgaggccaagaccaccagccacccagtggactcggtctctggggtgttctcctcatgcagccggggcagaggcctactggaccccctcagcctgctgctcagcatccttcccttctctgcagcagggcccggtcccaatggccaatggggctgctgccccagcagtgcctccctgtaggcccctcacctgcaccccaccttcacccagctctgggtttgcgctggtggcagctctgttttgtggatacggaaactgtacccaacttgatgccgctgggctggaaccttctgccccttcgaaatgaggcagtcagggacggggtggggtgcccccatcagccccgctgctcagggccactcatggactctaggagggtccaggttctgggcttcctgggaaggtccccagaagagagaggtgctggtagactagggaatgtgctggcaacttgacccagaagctgtggtccccttggccccggctccacggcatccgggtaccagcagcaagagcccaggccccgggctgcacgtcagctcacagcccaggagaaagctggctgcttcccctccctatgcgtctttcccccgctccaatcatgttccatctgggatctgaaatgggccaactgtggctgctttgggggtgacacgctccttctccaactcagctgggccccgggcatcccctgccctcccctgagacccaaagggggttggcacctgctgtgacaccaccgttgaccccagcctgggggccacaaggttgctgagtggggagaacatggaccccaactctatggcaagcaagatcgcagaagggggagcatcatccgcaaggacttcaggtctcccttggctggagatgaggatccacattaaatgcttgtaacacaccaggccacagaaagctcgctacacacacatgcttctccccacccatgctgactctcagaggctgctaaggcagaatttataggaaattgttttcaagccaccagagacctgtctgtacaactggaaaggctgtatttatttaatgtacctcaaggtgttttaataatgatccgtgttttaataaaaagaagtatttctgg

SEQ ID NO: 2229 - DNA, 2423 bp, Homo sapiens
atttatttgaaatgactatttgttgaacacagtatagttcaaggatattttttcatatgtatttccttaagagagccctgagcctgagattttggaggcttctttcacttgtttgaactttgaaggtatattttatctattttaaaaaacacttaagaattaacaaattctataaagcatcttttttcatagttttcattcatactttcagcaacttgaagggagagtttttaacgtagtctgtgtttttgagcactctgagcatttgatttcttcctggtatcaccggtaaatcactcaatatattattattcccaaaattcgtgaagctaagagatgagccatcttgaaaaacaacctggcatttgactggaggtgatactctctggaatcataggattaacaacttggaaaaggcctatgatactcctggtaaacctctttgtgctgctctctgtggtttgtgtcctcttaaatctagctggatttatcctaggctgccaaggggcccagtttgtgtccagcgtgcccaggtgtgatctggtggacttaggtgaaggcaagatttgcttctgttgtgaagaatttcaaccagccaagtgcacagacaaagaaaatgccttgaaactctttccggttcagccctgtagtgctgttcaccttctacttaagaaagtcctctttgccctgtgtgccttgaatgccctgaccaccaccgtctgcttggtggccgctgccctccgctacctccagatattcgcaaccaggagatcctgcatcgatgaatcccagatttctgctgaagaagcggaggatcatggacgcatccccgaccctgatgattttgtgccgcctgtgcctcccccttcctattttgccacgttttactcgtgcacaccccggatgaaccgcaggatggttggtcctgatgttattcccctgccacacatctacggagctcgaatcaaaggtgtggaagtgttctgtcctctggatcccccgccgccatatgaagctgtggtgagccagatggaccaggagcagggatcttcattccaaatgtcagaaggatcagaagctgctgtgatcccattggatctgggctgcacacaagtgactcaagatggggacattcctaacatacctgccgaagaaaatgcatccacctcaactcccagttcaaccctggtgcgtcctatcagaagccggagagccctcccacccttgaggaccaggtcgaagagtgaccctgtgctccatccttctgaggagagagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggc

SEQ ID NO: 2230 - DNA, 2051 bp, Homo sapiens
agaaaaataaggacttgaggttattgagaagacttaagagtcagtggcatccctcagcacaattttaagaagtctaaaatgtgaaaaaaagtttgtacattgaaaacacggttctgatctttttttaaaaaaatgttctcttggaagggaatatgagtttttaaaatcaggtggacttaggtgaaggcaagatttgcttctgttgtgaagaatttcaaccagccaagtgcacagacaaagaaaatgccttgaaactctttccggttcagccctgtagtgctgttcaccttctacttaagaaagtcctctttgccctgtgtgccttgaatgccctgaccaccaccgtctgcttggtggccgctgccctccgctacctccagatattcgcaaccaggagatcctgcatcgatgaatcccagatttctgctgaagaagcggaggatcatggacgcatccccgaccctgatgattttgtgccgcctgtgcctcccccttcctattttgccacgttttactcgtgcacaccccggatgaaccgcaggatggttggtcctgatgttattcccctgccacacatctacggagctcgaatcaaaggtgtggaagtgttctgtcctctggatcccccgccgccatatgaagctgtggtgagccagatggaccaggagcagggatcttcattccaaatgtcagaaggatcagaagctgctgtgatcccattggatctgggctgcacacaagtgactcaagatggggacattcctaacatacctgccgaagaaaatgcatccacctcaactcccagttcaaccctggtgcgtcctatcagaagccggagagccctcccacccttgaggaccaggtcgaagagtgaccctgtgctccatccttctgaggagagagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggcc

SEQ ID NO: 2231 - DNA, 1385 bp, Homo sapiens
gtggtgtcgtacatgacacaatgacgtgtttcgggccatatcctattggaactggacttcagggaataaccttgtgttgttttccctccttctgcaagatgaaaagcaggatgtgcatggctatcagcatttgtcagatgctttccatgttgagttttgtggtctgtgctttcaggtacaggcatatgttcaaaaggggttggccaatgggtacatgttgtttgtttctgcccacagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggcc

SEQ ID NO: 2232 - DNA, 2000 bp, Homo sapiens
gttctcttggtaaacctctttgtgctgctctctgtggtttgtgtcctcttaaatctagctggatttatcctaggctgccaaggggcccagtttgtgtccagcgtgcccaggtgtgatctggtggacttaggtgaaggcaagatttgcttctgttgtgaagaatttcaaccagccaagtgcacagacaaagaaaatgccttgaaactctttccggttcagccctgtagtgctgttcaccttctacttaagaaagtcctctttgccctgtgtgccttgaatgccctgaccaccaccgtctgcttggtggccgctgccctccgctacctccagatattcgcaaccaggagatcctgcatcgatgaatcccagatttctgctgaagaagcggaggatcatggacgcatccccgaccctgatgattttgtgccgcctgtgcctcccccttcctattttgccacgttttactcgtgcacaccccggatgaaccgcaggatggttggtcctgatgttattcccctgccacacatctacggagctcgaatcaaaggtgtggaagtgttctgtcctctggatcccccgccgccatatgaagctgtggtgagccagatggaccaggagcagggatcttcattccaaatgtcagaaggatcagaagctgctgtgatcccattggatctgggctgcacacaagtgactcaagatggggacattcctaacatacctgccgaagaaaatgcatccacctcaactcccagttcaaccctggtgcgtcctatcagaagccggagagccctcccacccttgaggaccaggtcgaagagtgaccctgtgctccatccttctgaggagagagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggc

SEQ ID NO: 2233 - DNA, 2107 bp, Homo sapiens
agtcctttcattcccgctcctaccgagatgccgggaaagcactcccgcgccgatgcgaggtgatactctctggaatcataggattaacaacttggaaaaggcctatgatactcctggtaaacctctttgtgctgctctctgtggtttgtgtcctcttaaatctagctggatttatcctaggctgccaaggggcccagtttgtgtccagcgtgcccaggtgtgatctggtggacttaggtgaaggcaagatttgcttctgttgtgaagaatttcaaccagccaagtgcacagacaaagaaaatgccttgaaactctttccggttcagccctgtagtgctgttcaccttctacttaagaaagtcctctttgccctgtgtgccttgaatgccctgaccaccaccgtctgcttggtggccgctgccctccgctacctccagatattcgcaaccaggagatcctgcatcgatgaatcccagatttctgctgaagaagcggaggatcatggacgcatccccgaccctgatgattttgtgccgcctgtgcctcccccttcctattttgccacgttttactcgtgcacaccccggatgaaccgcaggatggttggtcctgatgttattcccctgccacacatctacggagctcgaatcaaaggtgtggaagtgttctgtcctctggatcccccgccgccatatgaagctgtggtgagccagatggaccaggagcagggatcttcattccaaatgtcagaaggatcagaagctgctgtgatcccattggatctgggctgcacacaagtgactcaagatggggacattcctaacatacctgccgaagaaaatgcatccacctcaactcccagttcaaccctggtgcgtcctatcagaagccggagagccctcccacccttgaggaccaggtcgaagagtgaccctgtgctccatccttctgaggagagagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggc

SEQ ID NO: 2234 - DNA, 2550 bp, Homo sapiens
attcccatcccccttctctagtccccgacctgcggcagccggagctcggggagcggagcgtggtggggaggggagcgggacaggcgacacaggagacagcggcgccgcggcctctccccaccaggcggccccggatcctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgctggcgttctccggggtggttggcattgtgtcctggaagcggccattcactctagtgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttgcggcgtctcctgtctggccgcaggctggagcgtggtacccgcccccacagcctcagcctcaacgggggcagccgggagactgggctctgacctaggcttcttgtcacactga

SEQ ID NO: 2235 - DNA, 1386 bp, Homo sapiens
cctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttg

SEQ ID NO: 2236 - DNA, 2379 bp, Homo sapiens
aaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttgatca

SEQ ID NO: 2237 - DNA, 3082 bp, Homo sapiens
cagcggcgccgcggcctctccccaccaggcggccccggatcctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgctggcgttctccggggtggttggcattgtgtcctggaagcggccattcactctagtgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttg

SEQ ID NO: 2238 - DNA, 2609 bp, Homo sapiens
gagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgcagctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttg

SEQ ID NO: 2239 - DNA, 1499 bp, Homo sapiens
ggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgaacctgctcttcagcgtctgtgggctcaccatttgtgccgctataatctgtacactctctgctattgtctgctgcatccaaatcttctccctggacctcgtgcatacgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacag

SEQ ID NO: 2240 - DNA, 4900 bp, Homo sapiens
gtgaactgttgcaccgtgcaattgcacactataaatgtctttccttatctgtgtgtactcttatctcactgttctattttttctcctcatttatattaactctttcttacctttttttctgaacttctaggccttctctttccagaactggtggaagacaaatgaaacggccaagatggtaagaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcgccccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaagatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcgggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataatgggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagacactgactccattaataaaccatattttgtgccgttttgactgttctgaccaaatactaatgggaacaattcttgacgtttttctgttgctgattgttaacatagagcagtctctacactaccctgaggcaactctacattggaacactgaggcttacagcctgcaagagcatcagagctgaccatacatttaaacagaaatgctggtttatttgcaaaatcaccagtatattttctattgtgtctataaaaaatcagtcatttaagtacaagaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaattggttcaaatattgagtgtgtttcaatatattatctggcttatttcaacatgagtaatatgagcaaaataagttaaaacctgcgtctgatcaattttcctcatgactagaactaaaacagtaaatttggacaatattaagcctcaaataatcatctccaaactccttctaacactttttaaatcagattggaagacatggacaaatcaggttcatgtgttgcatctttatgtcctttgccaatatccaagatcatcacatatggtagatattcacatggagtttcaaattcagaatagattaccattaccttcctgcccttacacatcctactccttatttaaaagttctatttgtgacttttcatttcctgaaagtttaaaaatacaatttgagaatgtttataatacattctctcctgtcttttcacggttacgtctgttattgctgaaatacaccacattttctttgttctggtcaaggttaactcaatatctgtgtgaaagagaactactaacaacgttacaatagaggctagatttgaaaaaaaaaatctatagatctaattgatacaattgtagaacaaaatgtcaaaataatgttttaagtataagagaagatggaccaaggagagagagatcatttgaaaatctaattgtagcttttctaggctcacattcatgtactacttttagcacccttatgggctgtgctcgccccctggacagttgagctttggattatcttcctcttcaattttccctctattgacccgagtgtctccctctgcttctacagatttatagtactccttggctcttttgagtctccacttttactcactgtctctgggatttttaagatccttttcttctcttataaatcatcctcttaatgaaaattagcctaacaaaagtttggagactggaatcctactttgagccactgacttgaaataactcttttggcaagttgcctgacatcctgtcttaccaaggtggcatatttgcatttttactgcttaaaacatttttttttttttaccatctttatccaaatttatcatattgatggtaggactaacaggctttttagaagctggctttaactttgagtctcaagctacaatgctgttgggcagcctggtcttcccacgtgagggtttaactttgtttatttgcctccagttattccaaaatgcttattaaatgaaagtcccaggaacatgtttattttagtcacctttgctttttaacaattttgttttgtaatcaatgagtaattcatgatgaattatttttgactaatggatagccgaaggccaggcttttaattctaataggtaatgttcttcttttgtcttattgaaacaatgagaatactctgtgcatttcaaatgcactccgattatgctgtggttttattcacataagcacaatatgtgttttatttataacttcataacaaacttataatataataatttaccttagcagacatgcaaaagcttattcttgtgtgacttactttctttaagctaataatataaaaataaatatgtatcttaaaaatctataataaaacattagaaattaaagatatgtgctttttattttgcagatgagttcatttgcttttgtagatgtgttttcagagctaggtacagaggaatgtttgctacctttagcggtgaaaaaagaaagagagtcaagaattttgttggattgtgtttgtgtgtgcatatatttgatatcatcattatatttgtaatctttggacttgtaatcatagcctgtttattctactgtgccattaaatatactttaccttatacataacgaataaaatacctagaagtagatttatttacacactgtcttatgaaattcttatgtttatgtcagcacagaacaagcacacatttagagcattcatctgaaaattatatggaaattgaacatgggtcaaataaagatg

SEQ ID NO: 2241 - DNA, 4985 bp, Homo sapiens
ctcgatcttttgaacttcatgagactgacatttctgagtctgtttgcgaacaggacactagagggctcccaggggttaaaaataagtggaaatttatttgaatgaaaactgattctctacggcatttcttttttccgaatttaaaattaaagtttattttgttaactattgtttttaaaagctttgtatctcttaaaaccatgcagcagtcagtttccaagttttgctttgcaatcagtagttttcaagggagcttttaaagctgaactgaaatgtttgaaatgtggaacactcttgaccatgaaatatgttctacttacatgcctcagcctttaaaagttctttgcattagagtcaaggattacattcttcctggagccaagcatggggccagctgtaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcgccccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaagatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcgggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataatgggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagacactgactccattaataaaccatattttgtgccgttttgactgttctgaccaaatactaatgggaacaattcttgacgtttttctgttgctgattgttaacatagagcagtctctacactaccctgaggcaactctacattggaacactgaggcttacagcctgcaagagcatcagagctgaccatacatttaaacagaaatgctggtttatttgcaaaatcaccagtatattttctattgtgtctataaaaaatcagtcatttaagtacaagaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaattggttcaaatattgagtgtgtttcaatatattatctggcttatttcaacatgagtaatatgagcaaaataagttaaaacctgcgtctgatcaattttcctcatgactagaactaaaacagtaaatttggacaatattaagcctcaaataatcatctccaaactccttctaacactttttaaatcagattggaagacatggacaaatcaggttcatgtgttgcatctttatgtcctttgccaatatccaagatcatcacatatggtagatattcacatggagtttcaaattcagaatagattaccattaccttcctgcccttacacatcctactccttatttaaaagttctatttgtgacttttcatttcctgaaagtttaaaaatacaatttgagaatgtttataatacattctctcctgtcttttcacggttacgtctgttattgctgaaatacaccacattttctttgttctggtcaaggttaactcaatatctgtgtgaaagagaactactaacaacgttacaatagaggctagatttgaaaaaaaaaatctatagatctaattgatacaattgtagaacaaaatgtcaaaataatgttttaagtataagagaagatggaccaaggagagagagatcatttgaaaatctaattgtagcttttctaggctcacattcatgtactacttttagcacccttatgggctgtgctcgccccctggacagttgagctttggattatcttcctcttcaattttccctctattgacccgagtgtctccctctgcttctacagatttatagtactccttggctcttttgagtctccacttttactcactgtctctgggatttttaagatccttttcttctcttataaatcatcctcttaatgaaaattagcctaacaaaagtttggagactggaatcctactttgagccactgacttgaaataactcttttggcaagttgcctgacatcctgtcttaccaaggtggcatatttgcatttttactgcttaaaacatttttttttttttaccatctttatccaaatttatcatattgatggtaggactaacaggctttttagaagctggctttaactttgagtctcaagctacaatgctgttgggcagcctggtcttcccacgtgagggtttaactttgtttatttgcctccagttattccaaaatgcttattaaatgaaagtcccaggaacatgtttattttagtcacctttgctttttaacaattttgttttgtaatcaatgagtaattcatgatgaattatttttgactaatggatagccgaaggccaggcttttaattctaataggtaatgttcttcttttgtcttattgaaacaatgagaatactctgtgcatttcaaatgcactccgattatgctgtggttttattcacataagcacaatatgtgttttatttataacttcataacaaacttataatataataatttaccttagcagacatgcaaaagcttattcttgtgtgacttactttctttaagctaataatataaaaataaatatgtatcttaaaaatctataataaaacattagaaattaaagatatgtgctttttattttgcagatgagttcatttgcttttgtagatgtgttttcagagctaggtacagaggaatgtttgctacctttagcggtgaaaaaagaaagagagtcaagaattttgttggattgtgtttgtgtgtgcatatatttgatatcatcattatatttgtaatctttggacttgtaatcatagcctgtttattctactgtgccattaaatatactttaccttatacataacgaataaaa

SEQ ID NO: 2242 - DNA, 4900 bp, Homo sapiens; identical to SEQ ID NO: 2240

SEQ ID NO: 2243 - DNA, 4544 bp, Homo sapiens
gtgaactgttgcaccgtgcaattgcacactataaatgtctttccttatctgtgtgtactcttatctcactgttctattttttctcctcatttatattaactctttcttacctttttttctgaacttctaggccttctctttccagaactggtggaagacaaatgaaacggccaagatggtaagaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcgccccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaagcagcagcagcagcgtgtctttccatgcgcttggcattctttattttcccagcctgggaggatatgagagttccagggaaatgctgtattggacatgcaagactcacctggggaacttatcagcagttgctgaaacagaaatgctggcagaatggccgagtacccaagcctgaatcgggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataatgggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagacactgactccattaataaaccatattttgtgccgttttgactgttctgaccaaatactaatgggaacaattcttgacgtttttctgttgctgattgttaacatagagcagtctctacactaccctgaggcaactctacattggaacactgaggcttacagcctgcaagagcatcagagctgaccatacatttaaacagaaatgctggtttatttgcaaaatcaccagtatattttctattgtgtctataaaaaatcagtcatttaagtacaagaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaattggttcaaatattgagtgtgtttcaatatattatctggcttatttcaacatgagtaatatgagcaaaataagttaaaacctgcgtctgatcaattttcctcatgactagaactaaaacagtaaatttggacaatattaagcctcaaataatcatctccaaactccttctaacactttttaaatcagattggaagacatggacaaatcaggttcatgtgttgcatctttatgtcctttgccaatatccaagatcatcacatatggtagatattcacatggagtttcaaattcagaatagattaccattaccttcctgcccttacacatcctactccttatttaaaagttctatttgtgacttttcatttcctgaaagtttaaaaatacaatttgagaatgtttataatacattctctcctgtcttttcacggttacgtctgttattgctgaaatacaccacattttctttgttctggtcaaggttaactcaatatctgtgtgaaagagaactactaacaacgttacaatagaggctagatttgaaaaaaaaaatctatagatctaattgatacaattgtagaacaaaatgtcaaaataatgttttaagtataagagaagatggaccaaggagagagagatcatttgaaaatctaattgtagcttttctaggctcacattcatgtactacttttagcacccttatgggctgtgctcgccccctggacagttgagctttggattatcttcctcttcaattttccctctattgacccgagtgtctccctctgcttctacagatttatagtactccttggctcttttgagtctccacttttactcactgtctctgggatttttaagatccttttcttctcttataaatcatcctcttaatgaaaattagcctaacaaaagtttggagactggaatcctactttgagccactgacttgaaataactcttttggcaagttgcctgacatcctgtcttaccaaggtggcatatttgcatttttactgcttaaaacatttttttttttttaccatctttatccaaatttatcatattgatggtaggactaacaggctttttagaagctggctttaactttgagtctcaagctacaatgctgttgggcagcctggtcttcccacgtgagggtttaactttgtttatttgcctccagttattccaaaatgcttattaaatgaaagtcccaggaacatgtttattttagtcacctttgctttttaacaattttgttttgtaatcaatgagtaattcatgatgaattatttttgactaatggatagccgaaggccaggcttttaattctaataggtaatgttcttcttttgtcttattgaaacaatgagaatactctgtgcatttcaaatgcactccgattatgctgtggttttattcacataagcacaatatgtgttttatttataacttcataacaaacttataatataataatttaccttagcagacatgcaaaagcttattcttgtgtgacttactttctttaagctaataatataaaaataaatatgtatcttaaaaatctataataaaacattagaaattaaa

SEQ ID NO: 2244 - DNA, 3425 bp, Homo sapiens
actgttgcaccgtgcaattgcacactataaatgtctttccttatctgtgtgtactcttatctcactgttctattttttctcctcatttatattaactctttcttacctttttttctgaacttctaggccttctctttccagaactggtggaagacaaatgaaacggccaagatggtaagaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcgccccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaaggtaacagattcacatgcttcgttatttgcagctgttggggattctggttcattttcttttttccctcactctctttttctaaatgatttttctccacccacggttcacatttggacagcagcagcagcagcgtgtctttccatgcgcttggcattctttattttcccagcctgggaggatatgagagttccagggaaatgctgtattggacatgcaagagtaagcccatactgtataatctttgctctccatttccctcgcttcacttcccagtggcttattaaatctaattaaagccaacggcaatttgcatgatgaggagaggaagctaggctggaggcaaagaacttgctgacagtcaggcatactattaaataggttactatgggaggaagtagaagtttttaaaagtaagggggaagcgggttatcgttcttgagcagatggaatcttcttaagccgcgcagagccagaccatgttaggtttaaccccccctttttttttcaatggatttaacctctttatttaacaaataaaaagaatgagcaaaaattggtgatttgttcagtatgtatactaactagctgtgtggttttatcaagcccctgactatgatctattgagtctgtctttcaagattctcccgtcttgggtgacaaacattttggcaggttctaacacatgtagccagttactgcagttgccagcaaaaggactggtctgcggtcatgcccatgccatataaaggatattctctgaatattaaagctattccagggctcgaatacaaagtacagtgagtcagtggcttatgtttgaatgcagaatgatgccagaagttacaactttgaatccagattggcccaagaggctaaaatgtaccccaaagagattataagctgaaaggatacttaactttctccatgttaccatgaaatttagcatttcagtgaggttcccagggagcctagaatggaatggattaaaatccctgggagtggctgagacccaactgcatttccaatggctttagcattataatttcattttaaaatggatacccctggaagtaccagtgatttacttagaaaaattggacattccctactgatggtggttcttgtctaagtgctccagattcacaggtatgctttgatgtctcaagtttataaagcagtccaccacagttatgccaatgtaagaaaccttctcaaacatttaatctaatgttgataaaaatgaatttttattgggtgcccacaatttgctaaggattatacaaattgattcatatgtgttggctcctagaattttcataacaatgctatgaagtggggactattattatttccatttagtagatgagaaaattgaggcttattgagacaaagtaattggcctcaactcccacagctagtaggtggctaagctgggttttgactatagacccagcaaacttcagaacataacttcttagccactggacttaggtgaatatgtaacttattatccaaactggaaccgtgtggcgtgaaaggagatgctggtgggcattgggacaacaggcccacactgactgttctgagcagagtagagcacaggatcccccttgttatgctgaaatcccattcattttcatgtcataaaggccccagagaggagaagatgaactcctgtgtatatcctgaggcagagttctctgatatgtcctttgagcttcccttagacgctcttagactactgtattgggagaatgcagtagtggctaagagcctgggccgtggagttggactgactaggtttgaacttaccaatcatacgacttggaaatgttgccatgtctctttatgcctcagtttcctcagctgtaaaatgacaatactgcctaccatatgagattgttgttagttaatacagggaaaacacttagaaccagtatttgccacaagataaaccttcaataaatattggttattattattattattgtaccaagcacatgaggtaccaagttcattgaattcctcacataatctccaagtctcatgtgttacttcgttacgtgataggactatgactaaaactgctcaattaaacttttgtaatcccaa

SEQ ID NO: 2245 - DNA, 1943 bp, Homo sapiens
ccggatgaggaactcggaggaggagctgggcccgcgcgtccatgattcgaaggctcgttttcgcagcttttccacgtctttttccggtcccactgccctccatgctaactcactgggcgtctctagccgttataccaacaatgactgcgaccagtgttgggaaagcgccccctgggcccctccctgacgccagcccatccttgagactccctgcaaggaggcggcccgacccagtgggatagcaaaacctgatctcataaaacctaggtcacaaaggacagccctgcaaaacagaccctatttggatcaagtgagccagttcctggaacctgaataatgactcctgaatcaagggatactacagatttgtctccagggggtacccaggagatggaaggcatcgtgatagtgaaggtggaggaggaagatgaagaagaccattttcaaaaggaaagaaacaaagtagagtcatcgccacaagttctcagtcgctctacaactatgaatgagagagccttattgtcatcgtatttagttgcatatagagtggcaaaagagaaaatggctcacacagcggctgaaaaaattatccttccagcatgtatggacatggtacggacaatttttgatgacaaatcagctgataaactaagaactatacctcttagtgataatacaatatctcgtcgaatctgtacgattgcaaaacatttggaagcaatgcttattacacggctgcagtccggtatagactttgcaatccaactcgatgagagcactgatattgcaagttgtcccacactcttggtttatgtcagatatgtgtggcaagatgattttgtagaggatctcttatgttgtttaaatttaaattcacatataactggattagatttatttactgaattagaaaactgccttcttggtcagtataaattaaactggaaacattgtaaaggaatttcaagtgatggaacagcaaatatgaccggaaaacacagcagacttactgaaaaattgttagaagcaacccacaacaatgctgtttggaatcactgttttattcatcgagaagctttggtatccaaagaaatttcaccaagtctgatggatgtattgaaaaatgcagtgaaaactgttaattttattaaaggaagctcactgaatagccgacttctcgaaatattttgttcagagattggagtgaaccacacccacttattgtttcatacagaagttcgttggctttctcaaggaaaagtattgagcagagtatatgaactcaggaacgagatttacatttttctcgttgaaaagcaatctcatttggcaaatatttttgaagacgacatttgggtaacaaaattggcatatttaagtgatatttttggcattcttaatgaattaagcctgaaaatgcaggggaaaaacaatgatatatttcagtatcttgaacatattctaggattccaaaagacgttattattgtggcaagcaagacttaaaagtaaccgccctagctactatatgtttccaacattattgcaacacatcgaagagaacattattaatgaagactgcttaaaagaaataaaattagagatattgttgcatctcacttctttgtctcaaacttttaattattactttccggaagagaaatttgaatcattaaaggaaaatatttggatgaaagatccatttgcttttcaaaacccagaatcaataattgagttaaacttggagcctgaagaagagaatgaattattgcagctcagttcatcattcacactaaagaattattataagatattaagtttatcagcattttggattaagattaaagatgactttccactgctaagtaggaagagtatattgctgttactaccattcacaactacatatttgtgtgaactaggattttcaatcttgacacggtt

SEQ ID NO: 2246 - DNA, 2480 bp, Homo sapiens
gtgacgcacttccggcttttgtgacgctttccctgggctctgaaggccagggggcttggatgtgagtctagtgctcctggtccccaaagtcacaaccccttctatcccagcatcccagacttctccgggcggggacagagttggacgtgcatggctgtgtcctgcaatcccctcgccacgaccgcccgggacggagtggaagcgggtccgtgcccccgttcctcgcgccagcctcggcggtggcaagcgctgtcccccagcagaggtgtccctggatacaggatagcaaaacctgatctcataaaacctaggtcacaaaggacagccctgcaaaacagaccctatttggatcaagtgagccagttcctggaacctgaataatgactcctgaatcaagggatactacagatttgtctccagggggtacccaggagatggaaggcatcgtgatagtgaaggtggaggaggaagatgaagaagaccattttcaaaaggaaagaaacaaagtagagtcatcgccacaagttctcagtcgctctacaactatgaatgagagagccttattgtcatcgtatttagttgcatatagagtggcaaaagagaaaatggctcacacagcggctgaaaaaattatccttccagcatgtatggacatggtacggacaatttttgatgacaaatcagctgataaactaagaactatacctcttagtgataatacaatatctcgtcgaatctgtacgattgcaaaacatttggaagcaatgcttattacacggctgcagtccggtatagactttgcaatccaactcgatgagagcactgatattgcaagttgtcccacactcttggtttatgtcagatatgtgtggcaagatgattttgtagaggatctcttatgttgtttaaatttaaattcacatataactggattagatttatttactgaattagaaaactgccttcttggtcagtataaattaaactggaaacattgtaaaggaatttcaagtgatggaacagcaaatatgaccggaaaacacagcagacttactgaaaaattgttagaagcaacccacaacaatgctgtttggaatcactgttttattcatcgagaagctttggtatccaaagaaatttcaccaagtctgatggatgtattgaaaaatgcagtgaaaactgttaattttattaaaggaagctcactgaatagccgacttctcgaaatattttgttcagagattggagtgaaccacacccacttattgtttcatacagaagttcgttggctttctcaaggaaaagtattgagcagagtatatgaactcaggaacgagatttacatttttctcgttgaaaagcaatctcatttggcaaatatttttgaagacgacatttgggtaacaaaattggcatatttaagtgatatttttggcattcttaatgaattaagcctgaaaatgcaggggaaaaacaatgatatatttcagtatcttgaacatattctaggattccaaaagacgttattattgtggcaagcaagacttaaaagtaaccgccctagctactatatgtttccaacattattgcaacacatcgaagagaacattattaatgaagactgcttaaaagaaataaaattagagatattgttgcatctcacttctttgtctcaaacttttaattattactttccggaagagaaatttgaatcattaaaggaaaatatttggatgaaagatccatttgcttttcaaaacccagaatcaataattgagttaaacttggagcctgaagaagagaatgaattattgcagctcagttcatcattcacactaaagaattattataagatattaagtttatcagcattttggattaagattaaagatgactttccactgctaagtaggaagagtatattgctgttactaccattcacaactacatatttgtgtgaactaggattttcaatcttgacacggttaaaaacaaagaagagaaataggctcaatagtgcaccagatatgcgggtagcattatcttcatgtgttcctgactggaaggaacttatgaacagacaagcacacccatcacattaaatacaaactttacaaaattctgtgtatagccaggtgtggtggcttacgcctgtaatcccagcagtgggagaccgaggtgggcagatcacttgagttcaagaccagcctggccaacatggtgaaaccccatctctactaaaaatagaaaccttagccaggcgtggtggcacatgcctgcagtcccagttacttgggtgcctgaggcaggagaatctcttaaaccaggaaggcagagattgcagtgagctgagataatcccactgcattccagcctgggcaacagcgtgagacttcatctcaaaaaaaaaaaattgtatttgtacttttaaagggattttgcagtatgttgtagttaaacgttaataaaattatatttgt

SEQ ID NO: 2247 - DNA, 4225 bp, Homo sapiens
atagagggatggttgatctcatgctaatgaagtttagaccatgttgagccctacttttgttctgtgggaagttggatatcccttatacatctatggctccatcttcatcgttattgtaattatctggcaagtgaaaaggagccaccatgaattgagttcagaacctaaaaggagctgctgccggtgtcaccaaaaagtcaggcaaagagctagagatgcagcatcaacagctaggagacgttcccgggaagaagctgagaagccacagaagctgctctccatcattaaaagccagggctggcttcctctggagagaagtgtgcggcgaatcctgtgtgcagatccctgctgccaaatctgcaattctgtggctctggagattcagcaattgctggtgggtgagaacaaccagatctccctgactttatcggggccattgcagggctcctcttgcctagagatgctgtctacgtctagtatgtctttagatcagagtctggagtttcattcctggcacaccagagagctttcactgtcatctgtaaccccaacactgtcacaattaacagatcagaaatctttaacccagtcagctgcccagtcaacgtatgcagatggcatacaagattactgggctgatcacctccagctagggcaggaatttcaagtgccagatgtgctccggggcccaaacaccatagcttcttcaaggattgagaagccaagggctccactgaaccaggaggagatgacgcagagcaaccccagccttgtccagggaaaccaaggccagcatcacttgaattcccaggtctccttgctgtccctgaacccagaaaccctgaaccggatgcatccaatggccttgcatatggtcctccctgcccacctgccatttctcagtcctgaagtgctgaggcttcttgaggtacatgttaaaaaatggatgcatttccagaggtgggggctcccaagacgtgtggaggagtccctgaggcagcttatgccaaacccaccattgtattaccaacctggaaatgaccagccagtttctttcaacctgaagaatactcctcaggtctctcttcatagatttgagaccatttccctccagacctggtgttcatgtgtggctggccagcccatccagaccttctgggtttctgaatggtccacaatgaacccagaacaaagacaccactgtcagcaaactccaaaccctatggctctagccttgccctctccagcccttaaagccctaagtggcccccatccacagtctgggggacaagataatgactcagggagtgatctccagcagaaatacagccagctattctgtgggctcccttctctgcacagtgagtccctggttgccactttcatgggatctcaaggcctccccaagattgaaaatgtgcccaagccccccttgaaggatccttttctcttcaatgagctctccttcccccaactgctccctaaaacttcaccccagtcagccccaccctcttccccactttccccaaactggatgtctccatctgaccatcaacgagctcagatcaatgtcccatttctgactctggctgagtatgaagccttggagtggcacctgctacagaggcaactccagcttcagtggggctggccagctgccctccagaggtctcagcacacccagtgcctcatgcagcatgagccctgtggcaaagctcagtctcctgagaccacgacagcttcccagacagggaagtccatctcagtgctcaccagggaactactcttcttcccggagcatgcccggaagctgctggaattccacatccagaaacagttgattcgccatcgctggggcctgcctcagaagatccagcagtccatccagttgctccttacctccactgatcagcagactgtgtccagcagcagcacagccctagccaacgtgagcatcccccagcctgtagccctagaggccaacggggcttgcgatgtgctgtcacccattgcggccccagtgtccatccccaggccacacttgttaactcaggtcaaggcaatactgcagagccacatcgactccaaatgtggacaaatccaccagggcaagatccccgcctgtgtacacaggtcctgggactgcagaatttctggggtcctggcagtggctccttttccctgcattccagaaagccagttcctggaactgcagacagcaagtgacccggacctgcatcacaaagttatgccctggatgccaacggcccttgatcagcagcaacaggctttaccaggtactgtcactgaacaccctaagctgctccgagtcttgtctgtggaagccattgagaaactggagacaactttacggcacaagcatctggccttcctgtcggggctgcctgctctgtattatgtggcgctccccagggccctggccccggcagtcactagccaatctgtcatcacagagatggagcctagtcccgtggaaatcccagcagagcctctgattcagatggtttcatttgaagaacagtgtataagtcttgggccatgccctcaaggcaacaatgagagttgtacagacgttgcaaaagagttccagcctgcagtgccagtaaaaggaacaatggagacgctgcctctagaaagccagacgcatcctactagcccccactcactccagacacatatcttgaccaaactaaacttccacctgagaaaaaaggtcctagagatacaatggggaattcccattagggcaaggaagtccagggaacaaactgttgcagcaccagagaacatatccacacagaagtctcttgaaagtctaaaccaccaaggggagacattgctccaggaactgcccatcccaccagacactcttcctgcccctaatccagaaggggttcaccttaaagaacagctggccaatgacttgaaggcagtgcagcagaaccaaaagcaatccaattccaaagctgtaccccagggttctgcccactcggtctccaagatctcacagcccagtggggacatgacagaggcccacatgccttgtgttcaggtagaggccaatgtgaacaaacccagcctggaggaaccctgtggccctgagcctcaaagccctagcaagagcaaggacccagcccatgtccccatgctagcaggaaacagagaggacccagaggaaaccaaagcagccagggaccacagagaaggggatgcggggtttgggcgctcctcaaccagagaagagagacgccctgctgaagaccagaggccagcagggatgcttccaaacaagacaccccgagggtcctggcgatggagccgtagctttcatcttgctgatccctgtcaacacagcccccagcatcaccctcagcttaagctcccacagctacctccacgagtccctggggagaaagagtctgagaaggacctgcaagacagtcaaaccaagctaactgtcatccttgaaccagcgacaattcctgagaatgcccagactgtgttgccccaggcttcacagggtcagcctttcctgagccaaccaactcaggctaagcctttgcagggccaaactttgcaaggccaagttttgcatgggctggtgatgccagtccatgctcaaaagaagcccagccttacagagtctagcttcagaaataaaattaaatgttttctgcagcatattaaccccaagacaaaaggcaaagggcatgaggactccatgttctcagccgctgcgaaggtggccaaaaccagaaaagaaaatgttgcaaagagcctggctccagccaagagccctgtggggagaagtaagacggagaagccgacagggtgctccaaggcccaatctcgtcctgctcagaagctggtgggcccagccttcttggatggtccccaatccctagacgataagctccggctacactccagacaacctggctctgcctcagccctgggctacccccgccactgccctcgtcactgtcctcgagaggcttgtgccaacaaaccagggcacccaacctagctcctgaccctcacctcagatagaaacattggtccgctcaaggagaacatgcagagccatgaaaaagagtttataggctccccaactgctgcagccctccagaggaccagtattgtcatttccataaatgtgcaggtgggacagatgccactagaaatacactctatatttctcagc

SEQ ID NO: 2248 - DNA, 911 bp, Homo sapiens
aaatgaaaaacaaaaacatgatggcctctcccagcaaagctccagggttggaaagagtcccctggcagggaattggcaccccgtcgtgcccatcctctctctctgactgcctgctggaaatgcccccatctccctttgagtcctcctcccgggcaacccctgtgacctgtaacctctgtcctgaaatcatcacaatggccagagtggcctcagctcagggcctctgtgacatcaccaagggcctggcaccaggtgcccagtctcccagttgcgagggcaagcaaacccgtcatgagcaactcccttccccatctctgctcaccatgtggacgctgaaatcgtccctggtcctgcttctgtgcctcacctgcagctatgcctttatgttctcttctctgagacagaaaactagcgaaccccaggggaaggtgcaatacggagagcactttcggattcggcagaatctaccagagcacacccaaggctggcttgggagcaaatggctctggcttctttttgttgttgtgccgtttgtgatactgcagtgtcaaagagacagtgagaagaataaggagcagagtcctcctggccttcgaggcggccaacttcactctccattaaagaaaaaaagaaatgcttcccccaacaaagactgtgcattcaataccttaatggaactcgaggtggagcttatgaaatttgtgtccaaagtgcggaatcttaaacgtgccatggcaacaggtagtggcagtaacctcaggcttcgaaagtcagagatgcctgcagatccataccatgtcacgatctgtgaaatatggggagaagaaagctctagctgaatggatttgtgtgtcaggagagaaaaaagttgagtgttgacaaactgtatgcaaactaataaaactattctg

SEQ ID NO: 2249 - DNA, 694 bp, Homo sapiens
gacatcaccaagggcctggcaccaggtgcccagtcttccagttgcgagggcaagcaaacccgtcatgagcaactcccttccccatctctgctcaccatgtggacgctgaaatcgtccctggtcctgcttctgtgcctcacctgcagctatgcctttatgttctcttctctgagacagaaaactagcgaaccccaggggaaggtgccgtgtggagagcactttcggattcggcagaacctaccagagcacacccaaggctggcttgggagcaaatggctctggcttttgtttgctgttgtgccgtttgtgatactgcagtgtcaaagagacagtgagaagaataaggagcagagtcctcctggccttcgaggcttcccatttcgcactccactaaagaaaaatcaaaatgcttctctttacaaagactgtgtattcaataccttaaacgaacttgaagtggagcttttgaaatttgtgtccgaagtgcagaatcttaaaggtgccatggcaacaggcagtggcagtaacctcaagcttcgaaggtcagagatgcctgcagatccataccatgtcacaatctgtaaaatatggggagaagaaagctctagctgaatggatttgtgtgtcaggagagaaaaaagttgagtgttgacaaactgtatgcaaactaataaaactattctgaagaaaagaa

SEQ ID NO: 2250 - DNA, 4272 bp, Homo sapiens
ggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtg

SEQ ID NO: 2251 - DNA, 4519 bp, Homo sapiens
atcaggtcacgtgaggccggtcacgccccgggcagcttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaacc

SEQ ID NO: 2252 - DNA, 4642 bp, Homo sapiens
atcaggtcacgtgaggccggtcacgccccgggcagcttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaacc

SEQ ID NO: 2253 - DNA, 4326 bp, Homo sapiens
atgcccaggctttctggcaagtcagtgcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaaccaca

SEQ ID NO: 2254 - DNA, 3285 bp, Homo sapiens
ttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagtttggcaaactgtggcccccccactgtcatattttgttaataaaattttattggaacac

SEQ ID NO: 2255 - DNA, 782 bp, Homo sapiens
tccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggttagaaatcctctttaaggattttcagctcttgtttgcatcccagtacagagaaattccattatgcagacccacagttattcagacttgtctgcattaaggaggaaacagcaaccagggctaccgctttgtcttcactgcactccccccaagtcatctcccctctcctcgctccacacgccagagtttcatgaatctatactttaatagttagtgttttttgatgccatgccagatttaactctgaagtggagttaaggtaggatgaagaatcttcttcccactaaagaatttatttctccctctggatttccttggaatagaattaa

SEQ ID NO: 2256 - DNA, 4231 bp, Homo sapiens
cgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcacaccccccaagctgaccgacgaggacttctcgccatttggctctggaggtggcctgttcagtgggggcaaggggctatttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcatctctgctgcctggcaagctccccacgtcggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagccgaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccagaaacacctcaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatacctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacaggttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaa

SEQ ID NO: 2257 - DNA, 4326 bp, Homo sapiens
atgcccaggctttctggcaagtcagtgcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcacaccccccaagctgaccgacgaggacttctcgccatttggctctggaggtggcctgttcagtgggggcaaggggctatttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcatctctgctgcctggcaagctccccacgtcggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagccgaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccagaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatacctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacaggttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaaccaca

SEQ ID NO: 2258 - DNA, 827 bp, Homo sapiens
gagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccagaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagag

SEQ ID NO: 2259 - DNA, 3253 bp, Homo sapiens
atgcccaggctttctggcaagtcagtgcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcacaccccccactgaccgacgaggacttctcgccatttggctctggaggtggcctgttcagtgggggcaaggggctatttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcatctctgctgcctggcaagctccccacgtcggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagccgaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccagaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagtttggcaaactgtggcccccccactgtcatattttgttaataaaattttattggaacaca

SEQ ID NO: 2260 - DNA, 4263 bp, Homo sapiens
atgcccaggctttctggcaagtcagtgcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcacaccccccaagctgaccgacgaggacttctcgccatttggctctggaggtggcctgttcagtgggggcaaggggctatttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcatctctgctgcctggcaagctccccacgtcggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagccgaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccagaaacacctcaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatacctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacaggttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaaccaca

SEQ ID NO: 2261 - DNA, 4340 bp, Homo sapiens
gcagaagcttcactgagcgggcactggaggtcgcgagcacgttgctagtgggcgcggctggcggggccgggggcggcagggggctagcgtccggctgagcccggcgggttcctgcacgcggacccacgctttgtcgggctgctctgctgagtgacaccgccgtggcatccgaggagctgtggtccagcctgcgcggcgggaagcggcggcggcggctccagcgtcctaagagagtctcactctgtctcccaggctgcaacatccacctcccaggttcaagtgattcttgtgcctcagcctctccagtagctgggattacaggtgtgtgccagcatgcctggccaattgttggattgtatgaagctgaaacctatcaacactcttcaaaatgcaatggaatgtaccacggactgtatctcgactggcacgcaggacatgcttggaaccacataatgctggtctctttggacactgtcaaaatgtaaagggacctttacttttatacaatgctgaatccaaagtggttttggtacaaggccctcaaaaacaatggttgcatttatctgctgcccagtgtgttgcaaaggaaaggaggccattggatgctcatccaccccaaccaggagtccttcgccataagcaagggaagcaacatgtttcattcaggagggttttttcatccagtgccacagctcagggaactccggaaaaaaaggaagagcctgatcctttgcaagacaaatctattagtctttatcaacgattcaagaagacatttagacagtatggaaaagttctgattccagtgcatctaataacttctggtgtttggtttggaacattttattatgcagccttgaaaggagtgaatgtcgttccttttctagaactcattgggttacctgacagtgtggtaagcatcctgaaaaactcccagagtggaaatgccctcacagcatatgccttgtttaagattgcaacacctgctcggtataccgtgactttgggaggaacatctgtcactgtgaagtatctgcgcagtcatggctacatgtccacgccgccacccgtcaaggagtatctgcaggacaggatggaagagacaaaggagcttatcacagagaaaatggaagaaacaaaagatagactcactgaaaagttacaagaaaccaaagaaaaagtttcctttaagaaaaaagtggaataaggtgccttatatagcagtatagaaaattcctgcactttaaccctttggaaactatgggcaaagatacatgtgtctgattatttttttggttagttgccgaaatatactagttctctgagggttaaagaagtaaaatacctttttaaagttaaatatcactagaaaaatcagtgttattacaagggaagaaatgaacccagtttaagaatttgccatcagtagcagtattaagcagtggttaatgtcttagaagtcagacttctttttcaaggtcttcagaaccacacttgatttctgttttgttgcagctgtaattgacacatactaggcagctgactccttgaatatccagtgtgacccataaaatagtctgttaataccggatcttaatttttatgttattcattaagattttaactatattcagtacgtaatttggagacaaactagcatcatcaaaactgcctgtaaataaggtgtttagtctttctataaaaacagaatagagcagttacctaccagttaaaatatcttatatgaagaaaatagaataaagatccagtcatatatgtaaataagatgtactgattgtacgtaaatgaaaaatggaccctttaaaaattatttttacctgaagcttgtcataatttttttaaagcaaatatatatatggtgatggtacttttcaaagtgtgtattagtggtgatcacctcaaacataaacctctgttgtgaatcatttgtgtccttttcaactgtctttcagaggaaaggtaaaaaatcattaaaccttaaattcattgttaaaatcaaatatttgtcagcagtaactcaagctcatggttctcaagcagaaaaaggtttgggagactaaaaatggagtcaggttttcatggagactgctaactccttggggtagacatgggccttgcctcagcaaaccagtgcaatttcccaatgtcttagtttcagaattcatgctgatttcattatggagtaaagttttaaattgtggctgctgctttttgtcttacattgaagggaaatatccttgtttgagcattctacttgattttttttttttttttttttttttttgagacggagcctccctctctctctcccagactggagtgcaatggtacaatctcggctcactgcatcctctgcctcccaggttcaagtgatcctcccgcctcagctttccaagtagctgggagtataagcgtgtgccaccacactcagctaatttttgtatttttagtggaggtggagtttcaccatgttagccaggctagtctccaactcctgacctcagcctcccgagtagctgggactacaggcgcccaccaccacgcccagctaatttttttgtatttttagtagagatggggtttcaccatcttaacaaagctatcattaaatcatttgcttgtaatgaaattcagccgttgtcagctgtgagcgttgcggggctggtggggtgtgtttgagtatgtaagtgtctatttcctgtgctctaacagtgactatttcagttctaacccttcaattgctaattggatgagggaatggcctcttagattgtccttgttttgacttatctgctaaggcgagagaatgtctgggtttgccacacagtcccgcagggacccctgctctttgccaggatttttatatcaagtacttagtttggccaaatttagagtatagtttaaaggggaaaaaaagtttgtatttgatgagtctaattactatattagaatgctttttaaatgaatatgctgtgattggaatctcttcttgggggccggggagagtgctgagagatgcagctgtgtctctgctctctgcagtcttgggcaggcagcaccgctgtctcctgatacagagggttgaatgcactgcttcacattgatgccacattttcaaatctaaacatgattaacatgttttttaagtatttatcaaataattcacatttttgcaggtttaagtgctgttttttaagatattaaacatgttccttgtttcttttttctttttaaccactggagactatgtgaaaatcttgtgttatatggaatttttctaaaacaatttccttttacttttcatgttgcatattttccagtggggataaattggaggttcttattactaataatcctgaaactaaaatttgcttttcctgcatagacatcttttgttagtccatttgagttttgttgccatccagtttcatgatcatgttgtgttagtctaatagacaatgagttactgcttgaatgatatgaaattctctagtaaaaaatgctctgaagatgtgagaagctctgttgtattacttggcaccaggaatgttacaaaaatgttgttgctagcatattgctaacctagtccttaagtttcagggattcctgtaatatgttgagtttggagtattaatagcaggctaacagaatacagtaccaatatgccaagttaaataattgagaatatatacagtatagtttgctatgtataatagacctcatttcatttacagtacacctcacacttgggattaattcacctataacctctgtgaactgcgagtgctcggcagaagcagccctgtgtcttacatgtctacatttatatttatatttatatttatttttttgagacagagtctcactctgtcacccaggctagagtgcagtggcatgatcatagctcacttgcgtcttgaactcctggctcaagtgatcctcccacctcagcctgctgagtagctgggactacaggtgcacaccaccatgcctggctaaaggcatgtctgcatttatgcgaggtgtgttgaccgggtggggagggagctaggactgagattcgcctgtgtaaaatgcacaaaaagggtttgctaagcaaattgatatttgaaatgaaagatggattaggtgagagacttagtttattcaggaataagagcaaaaccaaccacatcaaaaaatgtatttcactgagacagccttttgtacatacagcagggtgctgtttacagatttcaagaaaggagaaaaagaatgcttatactgagattacctacctcccagtagtgaaaataataaatttatcccttgaaatataa

SEQ ID NO: 2262 - DNA, 4240 bp, Homo sapiens
aactacgagtcccgacgtgccgcgcgcggcatgcagaagcttcactgagcgggcactggaggtcgcgagcacgttgctagtgggcgcggctggcggggccgggggcggcagggggctagcgtccggctgagcccggcgggttcctgcacgcggacccacgctttgtcgggctgctctgctgagtgacaccgccgtggcatccgaggagctgtggtccagcctgcgcggcgggaagcggcggcggcggctccagcgtcctaagagaagctgaaacctatcaacactcttcaaaatgcaatggaatgtaccacggactgtatctcgactggcacgcaggacatgcttggaaccacataatgctggtctctttggacactgtcaaaatgtaaagggacctttacttttatacaatgctgaatccaaagtggttttggtacaaggccctcaaaaacaatggttgcatttatctgctgcccagtgtgttgcaaaggaaaggaggccattggatgctcatccaccccaaccaggagtccttcgccataagcaagggaagcaacatgtttcattcaggagggttttttcatccagtgccacagctcagggaactccggaaaaaaaggaagagcctgatcctttgcaagacaaatctattagtctttatcaacgattcaagaagacatttagacagtatggaaaagttctgattccagtgcatctaataacttctggtgtttggtttggaacattttattatgcagccttgaaaggagtgaatgtcgttccttttctagaactcattgggttacctgacagtgtggtaagcatcctgaaaaactcccagagtggaaatgccctcacagcatatgccttgtttaagattgcaacacctgctcggtataccgtgactttgggaggaacatctgtcactgtgaagtatctgcgcagtcatggctacatgtccacgccgccacccgtcaaggagtatctgcaggacaggatggaagagacaaaggagcttatcacagagaaaatggaagaaacaaaagatagactcactgaaaagttacaagaaaccaaagaaaaagtttcctttaagaaaaaagtggaataaggtgccttatatagcagtatagaaaattcctgcactttaaccctttggaaactatgggcaaagatacatgtgtctgattatttttttggttagttgccgaaatatactagttctctgagggttaaagaagtaaaatacctttttaaagttaaatatcactagaaaaatcagtgttattacaagggaagaaatgaacccagtttaagaatttgccatcagtagcagtattaagcagtggttaatgtcttagaagtcagacttctttttcaaggtcttcagaaccacacttgatttctgttttgttgcagctgtaattgacacatactaggcagctgactccttgaatatccagtgtgacccataaaatagtctgttaataccggatcttaatttttatgttattcattaagattttaactatattcagtacgtaatttggagacaaactagcatcatcaaaactgcctgtaaataaggtgtttagtctttctataaaaacagaatagagcagttacctaccagttaaaatatcttatatgaagaaaatagaataaagatccagtcatatatgtaaataagatgtactgattgtacgtaaatgaaaaatggaccctttaaaaattatttttacctgaagcttgtcataatttttttaaagcaaatatatatatggtgatggtacttttcaaagtgtgtattagtggtgatcacctcaaacataaacctctgttgtgaatcatttgtgtccttttcaactgtctttcagaggaaaggtaaaaaatcattaaaccttaaattcattgttaaaatcaaatatttgtcagcagtaactcaagctcatggttctcaagcagaaaaaggtttgggagactaaaaatggagtcaggttttcatggagactgctaactccttggggtagacatgggccttgcctcagcaaaccagtgcaatttcccaatgtcttagtttcagaattcatgctgatttcattatggagtaaagttttaaattgtggctgctgctttttgtcttacattgaagggaaatatccttgtttgagcattctacttgattttttttttttttttttttttttttgagacggagcctccctctctctctcccagactggagtgcaatggtacaatctcggctcactgcatcctctgcctcccaggttcaagtgatcctcccgcctcagctttccaagtagctgggagtataagcgtgtgccaccacactcagctaatttttgtatttttagtggaggtggagtttcaccatgttagccaggctagtctccaactcctgacctcagcctcccgagtagctgggactacaggcgcccaccaccacgcccagctaatttttttgtatttttagtagagatggggtttcaccatcttaacaaagctatcattaaatcatttgcttgtaatgaaattcagccgttgtcagctgtgagcgttgcggggctggtggggtgtgtttgagtatgtaagtgtctatttcctgtgctctaacagtgactatttcagttctaacccttcaattgctaattggatgagggaatggcctcttagattgtccttgttttgacttatctgctaaggcgagagaatgtctgggtttgccacacagtcccgcagggacccctgctctttgccaggatttttatatcaagtacttagtttggccaaatttagagtatagtttaaaggggaaaaaaagtttgtatttgatgagtctaattactatattagaatgctttttaaatgaatatgctgtgattggaatctcttcttgggggccggggagagtgctgagagatgcagctgtgtctctgctctctgcagtcttgggcaggcagcaccgctgtctcctgatacagagggttgaatgcactgcttcacattgatgccacattttcaaatctaaacatgattaacatgttttttaagtatttatcaaataattcacatttttgcaggtttaagtgctgttttttaagatattaaacatgttccttgtttcttttttctttttaaccactggagactatgtgaaaatcttgtgttatatggaatttttctaaaacaatttccttttacttttcatgttgcatattttccagtggggataaattggaggttcttattactaataatcctgaaactaaaatttgcttttcctgcatagacatcttttgttagtccatttgagttttgttgccatccagtttcatgatcatgttgtgttagtctaatagacaatgagttactgcttgaatgatatgaaattctctagtaaaaaatgctctgaagatgtgagaagctctgttgtattacttggcaccaggaatgttacaaaaatgttgttgctagcatattgctaacctagtccttaagtttcagggattcctgtaatatgttgagtttggagtattaatagcaggctaacagaatacagtaccaatatgccaagttaaataattgagaatatatacagtatagtttgctatgtataatagacctcatttcatttacagtacacctcacacttgggattaattcacctataacctctgtgaactgcgagtgctcggcagaagcagccctgtgtcttacatgtctacatttatatttatatttatatttatttttttgagacagagtctcactctgtcacccaggctagagtgcagtggcatgatcatagctcacttgcgtcttgaactcctggctcaagtgatcctcccacctcagcctgctgagtagctgggactacaggtgcacaccaccatgcctggctaaaggcatgtctgcatttatgcgaggtgtgttgaccgggtggggagggagctaggactgagattcgcctgtgtaaaatgcacaaaaagggtttgctaagcaaattgatatttgaaatgaaagatggattaggtgagagacttagtttattcaggaataagagcaaaaccaaccacatcaaaaaatgtatttcactgagacagccttttgtacatacagcagggtgctgtttacagatttcaagaaaggagaaaaagaatgcttatactgagattacctacctcccagtagtgaaaataataaatttatcccttgaaat

SEQ ID NO: 2263 - DNA, 3046 bp, Homo sapiens
agggccctcgccgggtcagctccgcccaccctccccggcctccgcccgcctcccgggtcagcggcgcgggtgctgcgcctagctgcgcaccatggccgggttgctggcgttgctgggtccggcaggcagggtgggcgcccgggtccggcctcgcgccacctggctcctgggcgccaccgccccctgcgccccgccgcccctggccctggccctgctcccgcccaggctagacgcccggctgctccgcacggcgcgcggggactgccgcggccaccaggaccccagccaggccacggggacaacaggcagcagcgtcagctgcacagaggagaaaaagcaaagcaagtcacagcaactgaaaaagatttttcaagagtatggcactgttggcgtgtcattgcacattggaatctcattaatttccttgggcatattttacatggttgtgtcaagtggtgtggacatgcctgcaatcctgctgaaactcggatttaaagagtccctggtacagtcaaaaatggcagcaggcacaagtaccttcgtggtggcctatgcaatccacaagctgtttgcgccagtgagaatcagcattacgctagtctctgtgcccttgattgtcagatattttcgaaaagtgggattttttaaacctccagctgcaaaaccttaatgaactcttcagtcgtacacactgaaaacctatttcttctaaattacatgatttggattggttttagggttttagggttgtagggtttcttttggagaggtagggggctaattgctatgttctcatggataaactttgccagcaaaaatcaggcttttgaacaattttaattttttgcctcataaattttgtgaatgctattcattatagggcttgtatatataatctaaaatgtcagcaaggcatcggagatgggttaacatctcaaaacaaaatagcctacaaatgttccttgtgggagactttggcgagggtctgtgggtaaaagcaccagggggttaatcttggctcagtttcctaaaaagcattgattaatttaactggcttttaaatatccccttccgctgatatttgttgtcagctgcctacagtttaatatgcagcgttcacaaaacagctgccagtgctacaattaatgaagcaaaacttaatatgtaatcacaatctaaattagcatcaatactttgacattcattacattggtttgggggaagaaaagtagttctggtatgtttcattgatccccagataccttccaatctggacatgatggggctgattccagatggtttttctgaaatttcattaaggtaggtcagcgtcatttgtctctgtttaggtaaaatataaaaaccctgcccagtagcagtggcatcgcttggttcctgatgcccatgttccagaggaattcggataccacaaacagctaagacaatctcagcttttcttagacaatcttctatctcaaacttcagacattccagaattgtcatgatgtttacactgtctgagttaaaaatcctgttcaagaaaaaaaaagattttgtatcacttcttaaaaaggaatattcatagcacttgtcacaaatagaaggcaaccatgagataatacaagccagggagaggcttgtattacatgacaggtgtaattagtctgctgagccagctttacccaatgaagggcatatgtgttagagagattagctaagagtagaaattcgagcatagaggccaggtgcggtggctcacgcctgtaatcccagcactttgggaggttgaggcaggcgtgtcacttgaggccaggagttcgagaccagcctggccaacatgatgaaaccccgtctctactacaaatacaaaaattagccgggtgtggtggcacacgcctgtagtcccagctactggggaggctgaggcagcattgcttgaacccaggaggtggaggttgcagtgagccaagatcacaccactgcactccagcctgggcgacagagggagacactgtctccaaaagaaagaaatcccagcgtagatccaaactgagacactgaggcttcgtccttatagtagtcaggagcaggcgattgaagtaattctgtcctgcggggttcagcatcatgcacgttccccctgggccattctctgatgcagggcacttgctccacactctgggaacccagattcaccagtctgccctgtcacgtagttgaaggagttgcatttatctttctggctcctaattcctttaaaattacatttgttgcagaacctccacaaggctaaataaaattacatttgtgaccatcagagaactgaataaaccattaactggccatcctggttttgcagagatcaggttgttgacagttcctggttgacccacagctacccatgtcagttatctccactaacatatccaagaatctttgtaggacaatttctccacctgcaaggtctttcaggtagaactcttcttttaaggcaattagcccattgccaaaaggttttactgtcttaaagctgtctttctgagatctaattccaaggacttctccacagctaagtgagatgcctcacaccattaggtgatgctttggacagaacagagtattttcatcttgtgtttaaagcaattccttggcttcggctcctcaccactttctatgccagtctcccatttatgtccctagtaatgcctatgcaaaaaaaaaaaaagaaaaaaaagaaaaactgatggtgaaacctacaggtttaagggcttaaatctcaaactttgttaggagtaacaggagcgtgctgagcgggcaagcaataaaacaaatcataccaaaaagccacattgctctctcctaagccccaaccccactccactcctgtggccaggggtccaaacagaaaataaccggagaagacaaggaggtcaaaggatcagggaactaagcattatgtgaattcaccagcaagatgtacagaacgcctgtgtttacattgtttttatggaactagcagaataaaacatctattttaaaaatgaaa

SEQ ID NO: 2264 - DNA, 1353 bp, Homo sapiens
gatcagaaagggccacaagctgatttgtgtaacagcttcccaagatgtgcccaactctcaacaatattgtgtcttctctgcagagaaatggaatatttatcaattctttaattgcagccttgactattggtgggcaacaactcttctcctcttctacattcagctgtccttgtcaggttggaaaaaatttctattatggttctgcttttcttgtcattcctgccttgatccttctcgttgctggctttgctctgagaagccaaatgtggacaattaccggtgaatactgctgcagctgtgcccctccatacaggagaatcagccccctagagtgcaagctggcttgccttaggttcttcagcatcactgggagggcagttattgctcctttaacttggctggcggtgaccctgctgacaggcacgtattatgaatgtgcagcaagtgaatttgcatctgtggaccattacccaatgtttgataatgtcagtgccagcaaacgagaagagatcctggctgggtttccatgttgcagatcagctccttctgacgtgatcctagtaagagatgaaatagctcttctgcacagataccagtcacagatgctgggttggattttgatcaccttggcaaccattgctgccttagtctcctgctgtgtggcaaagtgctgctctcccctcacctctctgcaacattgctactggaccagccacctccagaatgagagagaactctttgaacaagcagcagagcagcactctcggctcctcatgatgcatcgcataaagaagctatttggcttcattcccgggagtgaagacgtcaaacacatccgcattccttcttgtcaggactggaaagatatttcagtacccactcttttatgcatgggtgatgacttgcaaggtcactatagcttccttggaaatagggtggatgaggataatgaggaagacagatcaagaggtattgaattaaaaccttgattacagcacctttcatgagtcaggttgcttagcagatacttggcttttatggcttttatgatcaggccatttcaatgtaatctcttcatctttttctttctctctgatatttgtttacgtaagtccatctcaaatattatttctaaaatcaatctattagataattgtgccaatctctcattttgaaattttgccaatggtctggtaatgcctagagtggaatgtgaagtcacatggaaatttgcatcttagttctgttacttagtagctgtgtgaaaattaatatttctgagtgccattttgtcatctgcacattgtagctacctcctagagctattatgagaattaaacatgataatacaaa

SEQ ID NO: 2265 - DNA, 1311 bp, Homo sapiens
cccctgcctacactgtgctgagaactgctctctctgaccgggtctcctgtttctacctggtttgttgtgaacctgtgttctccacatttgtcctgactcttcaggtgaataactgagcctttcacttggctttgctgcaacccttcagctctgtgcgtgttggaagcaagaattggataagacttctcaggcgtctgcacaatccctaatggcccccagatctgccaaggagaccttcaggataaacccaaatgtagcagcaaatttatgctgggttggattttgatcaccttggcaaccattgctgccttagtctcctgctgtgtggcaaagtgctgctctcccctcacctctctgcaacattgctactggaccagccacctccagaatgagagagaactctttgaacaagcagcagagcagcactctcggctcctcatgatgcatcgcataaagaagctatttggcttcattcccgggagtgaagacgtcaaacacatccgcattccttcttgtcaggactggaaagatatttcagtacccactcttttatgcatgggtgatgacttgcaaggtcactatagcttccttggaaatagggtggatgaggataatgaggaagacagatcaagaggtattgaattaaaaccttgattacagcacctttcatgagtcaggttgcttagcagatacttggcttttatggcttttatgatcaggccatttcaatgtaatctcttcatctttttctttctctctgatatttgtttacgtaagtccatctcaaatattatttctaaaatcaatctattagataattgtgccaatctctcattttgaaattttgccaatggtctggtaatgcctagagtggaatgtgaagtcacatggaaatttgcatcttagttctgttacttagtagctgtgtgaaaattaatatttctgagtgccattttgtcatctgcacattgtagctacctcctagagctattatgagaattaaacatgataatacaaagtgtttagcacagtgtctttcataaaaatagatgctaatgaatgttactttctctctttctcttttgcattccatgtcttctattcaccattttccctgcctctattttctggttttatcagtttctacctttatataatgtccagaacttttcacagcctccccctctttcttcagacctaaatatctgaccttttgggaagcaggacagaaacctctttctaatccagtaacatgtgagggagaagcccatgcaggaagctcttgagttactgtactataacctggggaca

SEQ ID NO: 2266 - DNA, 1165 bp, Homo sapiens
gtgctgagaactgctctctctgaccgggtctcctgtttctacctggtttgttgtgaacctgtgttctccacatttgtcctgactcttcaggtgaataactgagcctttcacttggctttgctgcaacccttcagctctgtgcgtgttggaagcaagaattggataagacttctcaggcgtctgcacaatccctaatggcccccagatctgccaaggagaccttcaggataaacccaaatgtagcagcaaatttcaagtgaatttgcatctgtggaccattacccaatgtttgataatgtcagtgccagcaaacgagaagagatcctggctgggtttccatgttgcagatcagctccttctgacgtgatcctagtaagagatgaaatagctcttctgcacagataccagtcacagatgctgggttggattttgatcaccttggcaaccattgctgccttagtctcctgctgtgtggcaaagtgctgctctcccctcacctctctgcaacattgctactggaccagccacctccagaatgagagagaactctttgaacaagcagcagagcagcactctcggctcctcatgatgcatcgcataaagaagctatttggcttcattcccgggagtgaagacgtcaaacacatccgcattccttcttgtcaggactggaaagatatttcagtacccactcttttatgcatgggtgatgacttgcaaggtcactatagcttccttggaaatagggtggatgaggataatgaggaagacagatcaagaggtattgaattaaaaccttgattacagcacctttcatgagtcaggttgcttagcagatacttggcttttatggcttttatgatcaggccatttcaatgtaatctcttcatctttttctttctctctgatatttgtttacgtaagtccatctcaaatattatttctaaaatcaatctattagataattgtgccaatctctcattttgaaattttgccaatggtctggtaatgcctagagtggaatgtgaagtcacatggaaatttgcatcttagttctgttacttagtagctgtgtgaaaattaatatttctgagtgccattttgtcatctgcacattgtagctacctcctagagctattatgagaattaaacatgataatacaaa

SEQ ID NO: 2267 - DNA, 1119 bp, Homo sapiens
ggtgttttacccttgggtcctcccctgcctacactgtgctgagaactgctctctctgaccgggtctcctgtttctacctggtttgttgtgaacctgtgttctccacatttgtcctgactcttcaggtgaataactgagcctttcacttggctttgctgcaacccttcagctctgtgcgtgttggaagcaagaattggataagacttctcaggcgtctgcacaatccctaatggcccccagatctgccaaggagaccttcaggataaacccaaatgtagcagcaaatttatcagctccttctgacgtgatcctagtaagagatgaaatagctcttctgcacagataccagtcacagatgctgggttggattttgatcaccttggcaaccattgctgccttagtctcctgctgtgtggcaaagtgctgctctcccctcacctctctgcaacattgctactggaccagccacctccagaatgagagagaactctttgaacaagcagcagagcagcactctcggctcctcatgatgcatcgcataaagaagctatttggcttcattcccgggagtgaagacgtcaaacacatccgcattccttcttgtcaggactggaaagatatttcagtacccactcttttatgcatgggtgatgacttgcaaggtcactatagcttccttggaaatagggtggatgaggataatgaggaagacagatcaagaggtattgaattaaaaccttgattacagcacctttcatgagtcaggttgcttagcagatacttggcttttatggcttttatgatcaggccatttcaatgtaatctcttcatctttttctttctctctgatatttgtttacgtaagtccatctcaaatattatttctaaaatcaatctattagataattgtgccaatctctcattttgaaattttgccaatggtctggtaatgcctagagtggaatgtgaagtcacatggaaatttgcatcttagttctgttacttagtagctgtgtgaaaattaatatttctgagtgccattttgtcatctgcacattgtagctacctcctagagctattatgagaattaaacatgataatacaaagtgtttagcacag

SEQ ID NO: 2268 - DNA, 568 bp, Homo sapiens
gtgctgagaactgctctctctgaccgggtctcctgtttctacctggtttgttgtgaacctgtgttctccacatttgtcctgactcttcagttggaagcaagaattggataagacttctcaggcgtctgcacaatccctaatggcccccagatctgccaaggagaccttcaggataaacccaaatgtagcagcaaatttatgctgggttggattttgatcaccttggcaaccattgctgccttagtctcctgctgtgtggcaaagtgctgctctcccctcacctctctgcaacattgctactggaccagccacctccagaatgagagagaactctttgaacaagcagcagagcagcactctcggctcctcatgatgcatcgcataaagaagctatttggcttcattcccgggagtgaagacgtcaaacacatccgcattccttcttgtcaggactggaaagatatttcagtacccactcttttatgcatgggtgatgacttgcaaggtcactatagcttccttggaaatagggtggatgaggataatgaggaagacagatcaagaggta

SEQ ID NO: 2269 - DNA, 9784 bp, Homo sapiens
ctgctctgccaataacaaaggcacagcattttccctctgtgcatctccaacatggatgcttttcagggcattttaaaattcttccttaatcagaaaactgttattggctacagcttcatggctctgctgaccgtgggaagtgagcgtctcttttctgttgtggcttttaagtgcccctgcagcactgagaatatgacctatgggctggttttcctctttgctcctgcctgggtgttactgatcctgggattctttctgaacaataggtcgtggagactcttcacaggctgctgtgtgaatcccaggaaaatctttcccagaggccacagctgccgtttcttctacgtcctcggccagatcactctgagctcattggtggctccagtgatgtggctttctgtggctctgctcaatggaactttctatgaatgtgccatgagcgggacgagaagttcaggactcctggaactgatttgcaagggtaagcccaaagagtgctgggaagaacttcacaaagtatcttgtggcaaaactagcatgctacctaccgtcaatgaagaactgaaactctcccttcaggcccagtctcagattctaggatggtgcctgatttgttcagcgtctttcttctctctgctcaccacatgttatgctcgctgccgatctaaagttagctaccttcagctgagtttttggaagacatatgcacaaaaggagaaggagcagttggaaaatacatttctggactatgccaacaagctgagcgagaggaacctgaaatgtttttttgaaaacaagaggccagatccttttcccatgcctacgtttgctgcctgggaggctgcttcagagctgcattctttccaccaaagccagcaacactatagcaccctccacagagtggtggacaatggtctgcaacttagccctgaggatgatgagacgacaatggtccttgtgggtactgcccacaatatgtagctcatccaccatcaatgactcatggtgttgagtggcatgctcattctgtgatcctcctaacgtatcaccagcaacctgtgtgtctctgtattttcttacatttggagtatgtttacaagacaataacacaaaggaaactgctttgaagctctcaagtggaacatcaggatgtgctcaaattgatgctgaggggtgacaaaggtgctcttgcattggtggagaggggctcagtaggcctaaatgttgctccaagatctaagattttatcattcaacagacagactcatgtgagagggctcatcagtctctgtaaatattggttgcagaatttaggggcagaagcaatggcttgtgagtgagcaagttactcttaacataggttgccctacacagtggctcctgcagtgtgatcagcaggagtctctgtcctacaaatctacacttttaaggatgtatgaaattgtggaattcattccctcaggatctgaagatctcagttctcaaaaatcacaagttgcaagaatatgatacctaaaattgaaagtttttcacatgttttcactgtatactgaaaatactcccctggaagcagggctgcatcataatttttgtgggctttatgtacttttgcctttgcgaaccatttcctacattcaaaatagtagtaacaaatatatatatatatatatatatatatatatatatatatatatatatatacacacacacagaaatatatatttataactgcattgataaaaggtgaatatattagcattttcttcaacctaaaagtttatgtattttcttctgattttaaaagaaattaaaaacattttagtgggcccttacaagtattatggtccttaggcacagtgcttactaggccgtgggtatgtcttagtgcgtttgggctactataacaaaatatcatagataggtggcttatacaaaatagaaatttatttctcacagttctggaggctgggaagtccgaggtcaggctgccagcatgctcaggttctggtgagagcaattttccaggttgcaaactgcttgctgacttctcagtgtccttccatggtggaaagtgcaaataagctcccttgagcatttttataaggcactaatcccattcctggaggctccaccttcatgacccaattacttctcaaggctctgcttcttagtactatcagcttgggggttaagatttcaacatatgaaattgggggagacacaaacattcagactatagtagggtaaattgaccttggctaaaggtctggggacactgtccaaagcagtactggcataaaactgcattgcagtcttacatttatcagaaataatgcaaatcttgcattctacaatgtactatatccatgttagtatgtacatatatatgtgtatgtatatatgtacataaattctccttaaatctctgagaagaattgtgctttaaaaaagaactatgttttgtgctgtggctcataccttacagtggtagtctatgtctcttagtttgagaaagctgaatattaacttcttattaacatgaaacatgatggcaaactgaatcctacaagtataggacccagaacatatctatgttattgtcatttacaagaagaaatatgtatttggtctttcttcctattcctggtgcagagctcctaaaacctttgggacctcccaagtgatgtgtctggtagtacgcgaatgagatgactgatagttaggggcttctgaatggcctcagaatagggtctggttgccacgggaaccaaccatgtgtttagagggttggaactttcagccccactcccagaccttggggaaggaagaggggctgaaggttgagtcgatcacaaatggataatgatttaatcaatcatgcctaagaataaagcttcccataaaaatctaaaggacaaggttcagagagcttctgcattgctcaatacatgaggagtggtgagcccaaaggggccgtggaagctccgtgccccttcccccaaacctgttcctgtgcctccatctggctgtttctgagttatattattttataatagactgatgatagtaaataaagccctttcctgagttctgtgagctactctagcaaatggtgaaatctgagaaggaaatcatgggaacctctgctttgtagccacgtcagatagaagatgtgagtaactttggaacctactgcttgtgactggtgtctgaagttgggggagatcttatgggactgagctcttaacctgctggggatctgcacttaatgccgattaatgccagaattgaattgtatgatatccagttggtattggagaattggccagtgtgggagaaaacccacacagttggtggcaaggagtgttcagtgttgagtgtgaatgtcaataaaaaaaggtttgttttttctacgtacaatatctttgggaacttggaggtgcagggtcagacgtctgtgtgtgtatgtggcagggacagaacagggattagggatgtgagggggtagagttttcagaataaagggagagaaaattcagcaaagagttctccttcttaatctttcttgacttaaagtttgtctgcccttaagtgtcttctgagctggaaaaagacatataggaactggccgatgccgatgcctcttttgcagtgtgtgagaggctgaaacagaagttctacagaagtaggttagctgtaaggagctgaggattgaggagtcatatctgggggatattcctgccaccctcaagtccagggactttctgcactcaaaaaacttacgctcatgacaatgactgcctcattcaagaaaacccaagctgactggcaagaagccagcagcctgggtacttgttgctgcagcttagtaagtagcagaagagctcatcctcctcctctggaagaagccacttaacaggttctcatcctgactcctaaattccttaacagtcctttactcaggaataaaacaagtccaagaaaacttatctgtcccacaaatagtcctggaggcagtggagtaagatagggagagcaaattggtgtctgctcttgagtatcttgagggaatgggtatctagaggcagcaggatgaactggctttgatagcagagactttaaaatgtgtggaccattagttgtctttggatgtgctccctagaggctgcgcctgacacagggagctgtgtatacatgatttattaaaaggaaatcctcttaggagaaacatattagcaggataaacacaagaaagaatgcagttacaagtggagtctcaatcaatcccagaggaaattctgggacttcagcctcagcttgacctatgggggggctctggaatgtcagatttctcctgatcccaagtgtgctctggggcttccattgcagccaagagagagcattccccagaaaactccaggtgaggagtctccagtggcccaagggtgatcctccagaggaggttacactgccgaactgggacattggcaccctggatttgaatatctagagagggcacccaatggtcatactaatgtttgccataacagtctcttctaggtctagacttgaagcatatggaagggtccttgggctagagccaacccaagcccaggctgactcccttttaatacttctaattttccctgaagatctggtcttctccctaccaccactaccctattacataagagaaaaggattggagaatgctcttgaaaagaatgtgatgctttcccatacaaggaatatactcaaggaaaaatttcatggcacaaaatgctgattctgtccaatttatcccatgaataaattgtgtacacatatatatatgattcttttgtttttcctgtgcagttccttccttttttcaggctcaaccacttaattcagctttaggatacattcagcttattcatatcaaatataaagtgggagaaaaaaaggtatgtaacaaagattacaaaaataaggcatggcagacaaatcactacataattctatgcattataccttaaagtaatgtattgtaaaatatatgtgtccaaagcaacttttaaaatttttgtatggttttctacttgagacctttaaagcatcactaaaaatgtatacatttaatgagaaaacgatgacattattgattcaaattagttgtttcaaagcctgatgatccactgatttactctaaaaactggttaaagcaatccagaagtcactgggtagcagaaaactgctaccgcttctcacatgatatatttcaagtacttcaactattaactatattattctatttagactttggtggttccgaattctctaaggtaattatcttaattttctaatatttccctctcatttttctctcttattttaaatatcccctgttgtacaagccagaggatattaatttcctttgtgggtagtgcttggacttctctgattttagatcccaaaatcattaagaaaaagctaagaggttggcatgagaggttggatggaaagcatctatctgtgtttgtcagtagctctcgatgttggctgcaaattggaatcacctgggggcctttgacaatcacaatgtctggacccatttcctgagaacctgatgtaacttttctgggttagggcctgaacattgagatttcttttaaaagctttctaagtgattataatgtgcagtcatggtgaagaactactgattttatatggggagtcagtgaaggtggtgaggggctgtgaggttgaaatattggaaatgttatctggatttcaaacagtagagtatgataaaaatttaaaaactggctctccaggaaaaaagagacatcctaatatgatgtatttgccaatataccatgggttttcttgggctgggatgaactttcagaagttttacagtgagcatttttttttttatgaatttaaattggttctagctaagcaattttggagtatctttgatgtacctgggtctctcattttaataaacataacagtggtatgttagtcagggttctccagagaaacagaaccaacagtacaacagtatatatacatacatacatatatatgtgtgtgcatgtgtgtgtgtgtatgcgtgtatatatatatatgctacatatatgaaaggggatttcttgtgggaatatatattatatataacaaaacatgacaaatatataacaaaatatatgtgctatatatattgtgtgtgtatatatatatgaaagaggatttattgtggaaattggctcatgtgattatgaaggctgagaaggcccatgacgtgccacctgtaagctggagaatcagggaaatgtgtagggtggctcaagtcccagtctgagggcctgagaaccaggggagttgatggtacaaatcccagagccaaaggcaaaggaacctgaagtttttatttccaagggccaatagataaggagaatattggtgacccaactccaggagacagagaaaagattggtgacccaactcgagtggagagagagggagagagagagagacagagagcaaatttgcccatcctctccctttttgtcctacccaggccctcaatggattgtatggtgcctgcccaggttaggtgagggcagattttccttactcagtccactgattcaaatgccaatcttttttggaaacacccctacatacatacccagaaataatgctttaataactatctggctaccccttaatccaatcaagttgacatctaaaattaaccagcacatgtgataaattaaatatggttcaatggctccttctggcagatgtagtcgtgttatcctcactttgaatctgaccttatgaaccaataaaatatggcagacatgaggtagattgttaagcagtatcacagtttatgccttggtctcttacaatgttgcaatgctcaacagtctggtaaaagccactatgtaagaactgcaattactcagggactaccaagctctgaagaggcccaagctagccagtgggaggagagagagagagataaaaagagagagagagagagatcccaatggctccaattgtctcagatattctagcttaggggtcaggcatgtgaatgaaggagccattttaaacattcaggccccagtgtacacgacatggagaagaaccaggaagtccaaccaacagtgagaataaaaggccccagatctatggccctaatcaaatcattgcagccatctccaaacatttgacccactccagtggaggctgcaggctttgtagagaagtccttgccatgtcctatccaactccatgaccccaaaaatcatgagcttaaataaatgtttgtggctttaagccactgaattttggggcaatatgaagcgacagaacctgaacactaacatgaaaatcagaatttataaaaagacaaaaattacaggcaaattgtatttatacatttatacattctccctatgcatagagagcattttcttcaatcatgttttctttttctttaggttccagttagcagtatagcatctacagcatgatttgatagatgctgataagtaggtctctaaaatctctccaccaaagctggagattcactttcaattatttttggttaatttttgtttgaaaggaatacaaacatattattgggaggagtaacacattaaactattatttgtcattaatatctacgaaaaaatagcaagtgagggtttcagactaggctggccttcagtaagctggaaagagattgttcttctagtcgtctctcaaaatgttatcttcagactgtcaacatcagtatcacgatgaagcttgttagaaatgcagaatcagacagtatctaaaacctgttgagtcaagcctgcagtttaacgtgatcctagctgattccagttcaagctaaatttgataacactaaggcagtggttctcaaactttagtccatataaaaatcatctggagggcttattaaaatgtggattgctgaactccacccccagggtgtctgattcagtaggtctggggtgaggcaagataatctgcatttctaacaggttctcaggtgatactgatgctgctggtctagggactacatcttgaaaataactgctctacagcacagagcaggctattctggggaaggcaggctgtaagaaactcagaatcctggcctgcactccagatctactgaatcggtcatcagcccgtccaagattttggggtgcctttccattcattcaaggatacctttctattcattcaaggatatattttgtcctttaggaatattttaaagtttacttcacataagttttacatgtttcttgtaaactctatttgtaggtgttttctttgttcctgttgtaaatggtttcttttttccactatatctttctaagtgattgttgtctgagtacgtgaaaagctattgtcttatgcttattaattttatctctctactaattcttttattgtttgtagggcttttcagaatttgaaagtaaacattttgcaacctttgatgacaaaatggatctagacaataaataatgaattctaaactattaggtgaaagcagaatggggtcagacctatgcaatttgaagccactcatctatattagcatcactaaaaatcaaagcagatgctacgtgccttatgatgcaaggcaagaataagtacatagtatcacatgtgaaatattgtttcctaagaagctaaacctaatcaagtatttagacattactgctagtttataggaaacataagcaacaaaaaacaaggcaattagcaccacaaaaaaacaaccaggtacatctagatctaacagaacattccattttacagatgactcagtctccccacagattaacagtattaagaaaggagaataaaggagatataagtgacttaataaccagatatgctatatagaccttatttgtatcctgtttccaacaaccaactgtaacaagatatctttgagatatttaggaaaatatgaatgaatattagatgatttttagagaattattaattttgctatgtgtggtaatggtgtgccgatttatgttttttaaaaagttcttcagttagagatgtatatttaaatatttatgtgtgaactgccatgatgtctagaagtttctttaaaatactctagaaaaaagagtttagggagaaagctgaaagatgaaataagattggcaaaatatggaaactattgaagctggatggtaggtacacggaattcattacattattctctttacatttgtatatgtttgaaaaatttcataaggtacacaacaaaataaatgacatggtcacctcagttattttgctgaagttttgtcaatcaccccctgcttagctggagtttaccttctagtatcattctcagcaaaggctcacaggaatgctattctctgaattcttacatattcagcctgttggcctgttctcgaattgaaggacagcttgtctggttcatactttctctacatgagtgtattgtaagcattacttcattgtcttttgtcattgaatattgctgaggtggccacagcctgatttctgatgccatctctatttctttctttattactaacaagatgttttatcctatattctcattggtttctttatctttcatgtccaaaaatgttaaataggccttcaggtaggtctttttggaacgatttttcctgctacaagtttactctttcattgtggagaatcattttcttatatttcaataaaaaagttggaaaattttcaactta

SEQ ID NO: 2270 - DNA, 1109 bp, Homo sapiens
agaggaaccagaaatttgtccttgaataatgtttcccgacaacgaagaggcagaaggatctgggcctgtgcgcgacgccccgggggacgaggctcatggagaagtttcgggcggtgctggacctgcacgtcaagcaccacagcgccttgggctacggcctggtgaccctgctgacggcgggcggggagcgcatcttctccgccgtggcattccagtgcccgtgcagcgccgcctggaacctgccctacggcctggtcttcttgctggtgccggcgctcgcgctcttcctcctgggctacgtgctgagcgcacgcacgtggcgcctgctcaccggatgctgctccagcgcccgcgcgagttgcggatcggcgctgcgcggctccctggtgtgcacgcaaatcagcgcggccgccgcgctcgcgcccctcacctgggtggccgtggcgctgctcgggggcgccttttacgagtgcgcggccaccgggagcgcggccttcgcgcagcgcctgtgcctcggccgcaaccgcagctgcgccgcggagctgccgctggtgccgtgcaaccaggccaaggcgtcggacgtgcaggacctcctgaaggatctgaaggctcagtcgcaggtgttgggctggatcttgatagcagttgttatcatcattcttctgatttttacatctgtcacccgatgcctatctccagttagttttctgcagctgaaattctggaaaatctatttggaacaggagcagcagatccttaaaagtaaagccacagagcatgcaactgaattggcaaaagagaatattaaatgtttctttgagggctcgcatccaaaagaatataacactccaagcatgaaagagtggcagcaaatttcatcactgtatactttcaatccgaagggccagtactacagcatgttgcacaaatatgtcaacagaaaagagaagactcacagtatcaggtctactgaaggagatacggtgattcctgttcttggctttgtagattcatctggtataaacagcactcctgagttatgaccttttgaatgagtagaaaaaaaaattgttttgaattattgctttattaaaaaataaacattggta

SEQ ID NO: 2271 - DNA, 616 bp, Homo sapiens
cagtccccgaggcttggcaaagcaggagccctctgtggcagtgcttgggtgtcggggctctgaggatccggcctcacctctccacggggtcgacgggaacgtctccggatgccaggagtcgcaaagggccgaccacgatgaggaaaccccaggctgggacgggggaagcagcacgggatcccagcctcaggcctgcccggacggtgttggttggggatcaagatgagtacactgcagccgagaacaagagccccagaggaactctttgtcccacaggagagcagcggatccacgccagagaagatgcttgtatcttttcacggctcttctctgagaaatgaagccacaccacgatacagtcagcaagaggaagccgggaatgggagatggcaacagtccctgtcactggaacgctggcctccctggacaagccaccctttaggaaccccaccccttatgtctgtggcggtggcacggtgctgtatcctgcctgggctctggcctctactctctcctccctctggctctgcctcccctgtttctcaggggcctggatgcctctcgctctggccaaatgccttcaaaaaagatgacttcccagtccgtcagggagaca

SEQ ID NO: 2272 - DNA, 568 bp, Homo sapiens
gcggcgcgtgggggcgggacggggaggggcgcggccagccgggcttctgcttccgcgaccccggcggtgcagggcgggtggagtcgcggagtagtcctcatggccgccccgccggagcccggtgagcccgaggagaggaaggcatcttgtacgtcgttacatttatcatattggaagtcccttaagctcctaggatttttagatgttgaaaatactccctgcgcccggcattcaatattgtatggttcattaggatctgttgtggctggctttggacattttttgttcactagtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctct

SEQ ID NO: 2273 - DNA, 2631 bp, Homo sapiens
gcgccggagacggttagaaatggcggttggggcggagcagggggctggcgcgggaagcggggctgtctggctcggttacgcccccacctcgccaggaatctaggagtcggtttgttttccgaacccatctccttccgctctcccgcccctgcaggctgtgtgccgagcttggaagaaagtgtgacccgttcgacggaacaaaggacatgacagcccggccccgtgcggccactgcggagcgttaggaacattccctaaaatggcggccggcgcgtcggaacagggcgggaggcggcggcgcgtgggggcgggacggggaggggcgcggccagccgggcttctgcttccgcgaccccggcggtgcagggcgggtggagtcgcggagtagtcctcatggccgccccgccggagcccggtgagcccgaggagaggaagtcccttaagctcctaggatttttagatgttgaaaatactccctgcgcccggcattcaatattgtatggttcattaggatctgttgtggctggctttggacattttttgttcactagtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaa

SEQ ID NO: 2274 - DNA, 1873 bp, Homo sapiens
gtgggttgggcaggaacagatcataataagggaggtttatgattccagctggcacgctgtggccacaaataggatgtcagcttttgatcaatgaagctcatagggaaactccaaccctaagataaatgcaaagactgctttaatcaaggagagtctctggacactataattcctgtgagaacacgagaagatggtggagaaaatactcatccataggatactcactttgtttccaaatgccatagctcgaaaattactgctgatgttgacatttatcttaattttctggatcatttacttggcttcaaaagaccacacaaagttctcgttcaacttggaaaaccatattatcctgaaccaagggaacatcttcaaaaaatattcacactctgaaacaccactgtgtccagcagtttcaccaaaagagactgaacttagaataaaggacattatggagaaactagaccagcagatcccacccagacctttcacccatgtgaataccaccaccagtgccacacacagcacagccaccatcctcaaccctcaagatacgtactgcaggggggatcagctggacatccttctggaggtgagggaccacttgggacacaggaagcaatatggtggggatttcctgagggccaggatgtactccacagcactaatggcaggtgcttcaggaaaggtgactgacttcaacaacggcacctacctggtcagcttcactctgttctgggagggccaggtttccctgtctctgctgctcatccaccccagtgaaggggtatcagctctctggagggcaaggaaccaaggatgtgataggatcatcttcactggcctgtttgccaacagaagctccaatgtcttcactgaatgtggcctgaccctaaacacaaatgctgaactgtgccagtacatggatgacagagaccaagaagccttctactgtgtgaggcctcaacatatgccctgtgaggccttgacccacatgaccactaggacaagaaatatttcctatcttagcaaggaagaatggaggcttttccacaggtccaacataggagttgaaatgatgaagaactttacccccattgaggtcataccatgcaacaagagcgagaacataaaaaagaactgccagattggaatgaagactcctttccccagtggttatactttgaaaaaaatgtggattacagcattttgtaaacagatcaagttcaatgaaacaaaaaatataaatgactgcttggaaagaaaacttatttatctcatgggagattcaacactgcatcagtggatttactacttacaaaaagctgtgaaaaccctaaaatattttgatcatcatggagctgggatctttaaaacacatgttcttctggatgttgaaagacatattttgattcagtggaaaaaacatggtcatccatttgttaccaaaaaattattctcagtgaaagatgaaaactatatcccacgggaaattgaccaggtagcaggagacaaaaacacagccattgtcattaccctcggccaacacttcagaccctttcccatcaacattttcatccgtagggccatcaatattcaaaaggccattgaacgtctattcttgcgaagcccggagaccaaggtgatacttaaaactgaaaacaccagagagatagaacaaaatgcagagatgttcagtgactttcatggctatattcagaatcttatcataagagatatttttgtggatcttaatgtgggtattattgatgcctgggacatgacgattgcatattgcaccaacaatgcccatccaccggattatgtgattcaaaatcagattggcatgttcttaaactacatttgttagagg

SEQ ID NO: 2275 - DNA, 2205 bp, Homo sapiens
agagtctctggacactataattcctgtgagaacacgagaagatggtggagaaaatactcatccataggatactcactttgtttccaaatgccatagctcgaaaattactgctgatgttgacatttatcttaattttctggatcatttacttggcttcaaaagaccacacaaagttctcgttcaacttggaaaaccatattatcctgaaccaagggaacatcttcaaaaaatattcacactctgaaacaccactgtgtccagcagtttcaccaaaagagactgaacttagaataaaggacattatggagaaactagaccagcagatcccacccagacctttcacccatgtgaataccaccaccagtgccacacacagcacagccaccatcctcaaccctcaagatacgtactgcaggggggatcagctggacatccttctggaggtgagggaccacttgggacacaggaagcaatatggtggggatttcctgagggccaggatgtactccacagcactaatggcaggtgcttcaggaaaggtgactgacttcaacaacggcacctacctggtcagcttcactctgttctgggagggccaggtttccctgtctctgctgctcatccaccccagtgaaggggtatcagctctctggagggcaaggaaccaaggatgtgataggatcatcttcactggcctgtttgccaacagaagctccaatgtcttcactgaatgtggcctgaccctaaacacaaatgctgaactgtgccagtacatggatgacagagaccaagaagccttctactgtgtgaggcctcaacatatgccctgtgaggccttgacccacatgaccactaggacaagaaatatttcctatcttagcaaggaagaatggaggcttttccacaggtccaacataggagttgaaatgatgaagaactttacccccattgaggtcataccatgcccggcattattttattttatttttcgagacagtctcactctgtcaccaagactggagtgcagtggcatgatctcagctcattgcaacctctgcctcccgggttcaagcgattctcctgactcagcctcccacgtagctgggatcaccagtgtgcagcgccacacctggctataaaccatttttaagcgtacaattcagtgatattaagtaatttacaatgttgtgaaaccctcatcatgatccatctctggcacatttttaacattccaaaaagaaacttggtacctattaaacaataactccccattcgctcctgtccttggcccatggcaaccgccattgtattttctgtccttctgaatttgactattttaggtagctcatataagtgggaacatgcagcatttgtccttttctgtctggcgtatttcacttagcatatgtctttaaggttcatccatattgtagcatttgtcagaattttccttcatttttaagactgaataatattccgttgtaagtatgtactacattttgtttatccattcatttgttgatcgacatttgggttgtttccccttttggctactgtaaatagtgcttctaggaagagaaaaccaaatttaaaggcatgtctccagtgctgagcatgatgattgaatagcaaatcatcatcacccataatttgaagacatgtgcagcccagaaatgcatagattaaatgattcaagtttagagaaaatgtgatgtatacaggaaaacttagtgggatcataatagcagtcttcttgcttaggaaaattatttggaacttagtaaccagttgttctctagattccagtaagaatcatggatcacacttcaaaacccacaggctcattgagagaaaacaacttagtattatgttaacgtacagaccccaaaaccttgattcttggatatcctaaaatatgatttgggatcccctccagagggcctcaaatgacaaattttgtctctaaatcttcctctcattagaaagatatacaccctttctattaatatactctaggtctcaagagtaggaatattgttattaaggatacttcccctcttaggactgtgtttcttagttagaggaagtgaagttataatgctgtaacatcagtacaaagtttgggtcgtcaggaggtggaggttgcagtgagccaagattgcaccaccacactccagcctgggtgacagagcgagactccatctc

SEQ ID NO: 2276 - DNA, 1481 bp, Homo sapiens
gccagacagctaggtgtcattcagggctggtgtcctctgtccaggccatcatggcctccactgccggctacatcgtctccacctcctgcaagcacatcattgatgaccaacactggctgtcctctgcctacacgcaatttgctgtgccctacttcatctacgacatctacgccatgttcctctgtcactggcacaagcaccaggtcaaagggcatggaggggacgacggagcggccagagccccgggcagcacgtgggccatagcgcgtggctacctgcacaaggagttcctcatggtgctccaccatgccgccatggtgctggtgtgcttcccactctcagtggtgtggcgacagggtaagggagacttctttctgggttgcatgttgatggcagaggtcagcacgcccttcgtctgccttggcaagatcctcatccagtacaagcagcagcacacactgctgcacaaggtgaacggggccctgatgctgctcagcttcctctgctgccgggtgctgctctttccctacctgtactgggcctacgggcgccatgccggcctgcccctgctggccgtgcccctggccatccctgcccacgtcaacctgggcgctgcgctgctcctggcccctcagctctactggttcttcctcatctgccgtggggcctgccgcctcttctggccccgctcccggccgcccccggcctgccaggcccaggactgaggccgggggccgggaccctccccctccccacccccacccccgtggagacagggctctggggctgatggctggggttgggagccagggtcctcttgcccggacaaccccaggactgacgatgaccccgaaagggaagaggccccatctctcggggactgagggggtggagagaggggacctcttccccctactctgcccccttcctgcacacccttgcgctggaggaggggagggggcaccgcctcccacccactgagggcaggagggcttgtggggagggacaccaacagggtttcaaggggaccaggagtcagaatgtggggagacgcctctgccaaggccatcccagcccctatgctgccatcccccagggctccccatcacccgagaggagaggacgccccaactaacccccgctggccctcgggcctcccgagtggccggctgcaaccacggctcctctccagggtaggccagcttgaggaatcttatttattttatttatttacccaaatttgaactagtctgttgggttgggggaaggaggtggctgctacccccaagccttcccagtgctgacaaccccgggggcaggcgagggcgcccagtccctcaccatcggctgcacatcgcgccctcgggccctgccatgtccctggtgctactgacctctcaaggcttcctccaatctggggtcgggggaccctgggaggtgctttacagaccgctaataaaagacgatctgcgtgaacgcca

SEQ ID NO: 2277 - DNA, 1927 bp, Homo sapiens
cctcccctcccccatccgcatcctcctcctcctgtcccctcttcctctctgtccctcaccaagccatcccctctttgcctctccccatccctcgctggcctgctcctgctccccttctcccatcctcccctcccccgtctctgcccagccagccccctcccgactccccagtttcatcggactccctggccccatcccgtccccgccctggcccctttgtgccccttctcatcgttttctccctccttcccgggcttggcgtcccttctccacccctaactccttccactcggcctccctgccccttcacggcccgcctgcctccctgcccaagtcctgagccaccatgctgaccccgatggtggccgggggggtggtgttccccggactcttcctcctctccaagaacacgctccagcggctgccccagctacgctgggaggaggccgacgcagtcattgtctcagccaggctggtgtcctctgtccaggccatcatggcctccactgccggctacatcgtctccacctcctgcaagcacatcattgatgaccaacactggctgtcctctgcctacacgcaatttgctgtgccctacttcatctacgacatctacgccatgttcctctgtcactggcacaagcaccaggtcaaagggcatggaggggacgacggagcggccagagccccgggcagcacgtgggccatagcgcgtggctacctgcacaaggagttcctcatggtgctccaccatgccgccatggtgctggtgtgcttcccactctcagtggtgtggcgacagggtaagggagacttctttctgggttgcatgttgatggcagaggtcagcacgcccttcgtctgccttggcaagatcctcatccagtacaagcagcagcacacactgctgcacaaggtgaacggggccctgatgctgctcagcttcctctgctgccgggtgctgctctttccctacctgtactgggcctacgggcgccatgccggcctgcccctgctggccgtgcccctggccatccctgcccacgtcaacctgggcgctgcgctgctcctggcccctcagctctactggttcttcctcatctgccgtggggcctgccgcctcttctggccccgctcccggccgcccccggcctgccaggcccaggactgaggccgggggccgggaccctccccctccccacccccacccccgtggagacagggctctggggctgatggctggggttgggagccagggtcctcttgcccggacaaccccaggactgacgatgaccccgaaagggaagaggccccatctctcggggactgagggggtggagagaggggacctcttccccctactctgcccccttcctgcacacccttgcgctggaggaggggagggggcaccgcctcccacccactgagggcaggagggcttgtggggagggacaccaacagggtttcaaggggaccaggagtcagaatgtggggagacgcctctgccaaggccatcccagcccctatgctgccatcccccagggctccccatcacccgagaggagaggacgccccaactaacccccgctggccctcgggcctcccgagtggccggctgcaaccacggctcctctccagggtaggccagcttgaggaatcttatttattttatttatttacccaaatttgaactagtctgttgggttgggggaaggaggtggctgctacccccaagccttcccagtgctgacaaccccgggggcaggcgagggcgcccagtccctcaccatcggctgcacatcgcgccctcgggccctgccatgtccctggtgctactgacctctcaaggcttcctccaatctggggtcgggggaccctgggaggtgctttacagaccgctaataaaagacgatctgcgtgaacgcca

SEQ ID NO: 2278 - DNA, 2574 bp, Homo sapiens
ggcggggagcccggccgccagcgctcgggtccgcctctgactgcagcgcggcggggcgatgtgtgattaccatggcgaggagtctctgtccgggggcctggctaaggaaaccctattacctccaggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagttattgatgggcctgcatgtaacagcctttgtgttacagaaactctttactttggaaaatgtttatccaccaagcccaacaatcagatgtatttagggatttgggataatctaccaggtgttgtgaaatgtcaaatggaacaagcgcttcatcttgattttggaactgaattggaaccaagaaaagaaatagtgctatttgataagccaactagaggaactactgtacaaaaatttaaagaaatggtctatagtctctttaaggcaaaattgggtgaccaaggaaacctctctgaactggttaatctcatcttgacggtggctgatggagacaaagatggccaggtttccttgggagaagcaaagtcggcatgggcacttcttcaactgaatgaatttcttctcatggtgatacttcaagataaagaacatacccccaaattaatgggattctgtggtgacctctatgtgatggaaagtgttgaatatacctctctttatggaataagccttccttgggtcattgaactttttattccatctgggttcagaagaagcatggatcagctgttcacaccatcatggccaagaaaggccaaaatagccataggacttctagaatttgtggaagatgttttccatggcccctacggaaatttcctcatgtgcgatactagtgccaaaaacctaggatataatgataagtatgatttgaaaatggtggatatgagaaaaattgtgccagagacaaacctgaaagaacttattaaggatcgtcactgtgagtctgatttggactgtgtctatggcacagattgtagaactagctgtgatcagagtacaatgaagtgtacttcagaagtgatacaaccaaacttggcaaaagcttgtcagttactcaaagactacctactgcgtggtgctccaagtgaaattcgtgaagaattagaaaagcagctttattcttgtattgctctcaaagtcacagcaaatcaaatggaaatggaacattctttgatactaaataacctaaaaacattattgtggaagaaaatttcctacactaatgactcttagttcatttggacataattaccattttaagaaacctgccacttttaaagaacaattttgagcattaaaaaaaaatggcttcaaattccggccagttacacaaaactccttccccccaggcctgagaagccatcagtatgtgatcactgaagtaatggcaggtgtaggatcaacaggtccccaagatgtcattcctgcccttttagaagccctgttacatctccgaagtacattcattgtgtaactattttgactgactttaaaaaccaatgctgtgaaaagcttcattccataaacatcaacagtgagtgatttgtagatttaccttagccaaaataccaatgctggaagcattgtgtttgcattgaagctgctgttcaacaagaaaatttataaatttactaatgtcttagcatggtaaagtttgcacattaacagaaattaagactgcaaagcaggttaaacttgcttctttataaaacagatgttgggttaatagcatggtttactgtattaaagacttatacacccatttttaacctcattcagacatcaagttatgtgtagcttcacaatggttcaagtggcttacttcaagaaatcttatacttgacagtacaccaattttattgactaaaaatggatgaactttcctaaagattcaaagggcccatcttagtatcacgcagctgactgagcccttcaaaactgacatcttaaggcccaatcaagatccacatatcctgattttgaactatgtgaaagtgggactgtaagtgcaagactaaaataaattatagcagactttttagtaataactttccattttcaaacagtatatcctgtgggccaaagggctatttcttaaagaggcatgtaaatgtatttatttatctaatgtttttttccccatgtaaacttgatatacaaggtttagtatttgctcctctttcatattattttcacacgtatactcagatttggcatgtacctttcaacatctccataaaattaaacaccttttggagaaaagaaccactattttctgctcaaaggtttcgcctacctaaagtggaacatgttaaaaatctatgtgaccatcactggacagctttctctcaaaactttccttcaacgccatggattagcaccagttttgtttactttaaggtacttttcccattcatcatctggttataataaatggatggaagaaata

SEQ ID NO: 2279 - DNA, 579 bp, Homo sapiens
agggggcggggaggcggggggaggcggggagcccggccgccagcgctcgggtccgcctctgactgcagcgcggcggggcgatgtgtgattaccatggcgaggagtctctgtccgggggcctggctaaggaaaccctattacctccaggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagttattgatgggcctgcatgtaacagcctttgtgttacagaaactctttactttggaaaatgtttatccaccaagcccaacaatcagatgtatttagggatttgggataatctaccaggtgttgtgaaatgtcaaatggaacaagcgcttcatcttgattttggaactgaattggaaccaagaaaagaaatagtgctatttgataagccaactagaggaactactgtacaaaaatttaaagaaatggtctatagtctctttaaggataggcataga

SEQ ID NO: 2280 - DNA, 2410 bp, Homo sapiens
ggccgcagcctgtcctcctgcctcagcctggggaaggctgggccgggccaaagagggaggccaagtccttgggacaggaggagacccacacctgagattagtggaaacccagccagaagctgccatgcaggtgtggctctgggcatcaggatctgtcgtgagagcccccatgagtgcccagtgcagaatggctggcagcccgccctgacggggagcagaggggctggacgcggtgcccttcacgggatgacacccagctgtttgccctgtgtccagggggttgcttctctgacagaggccctatggctcgtgtctgactcctgtccaggttctgccagcctgaccatccatcgctctggcaccaagagcccacccttttgttcttcctggcgtcccagggaaagccctgcctgggtggggcagctcctggcccttcagatggaagacgcagtccagtcagcaccatcataggaaacaagttcagaaatgtctcacttactattccgggcagggagggcgccatgagtcagggggtgcatcctccctcctggcgtcacccgaggcaggaatgaagagtcaggcagagagcgcgcgtgtggcagctggtggtgtagatattagggactagtgtgaattctagttcaccggccaatgcctggatggtccagagctgggtcggctgggcggagagctgcctccaggttcctgcctctggccctggcgtggggtcgacactgggtgtggtgtgtgtctcatgtccaggcagtggcctttgctgtgccgtcctgttacaggagccaggatggtggggacgggaccggaccggagggttggcggggctgcccctgcagccgacagccccatcctgcagccaccaatggcatgacccagggccccggcactgcctgtgtgaggggctggcagctttccaactgcagcaagtggaggcccctgccagcttcgggcctgtgggcaggggctcagtggggcaggggtgtggctgccccgcccggcacgcctgcacctgtctcctcagtgtgaccagtaccgcaaggggatcatctcgggctccgtctgccaggacctgtgtgagctgcatatggtggagtggaggacctgcctctcggtggccccgggccagcaggtgtacagcgggctctggcgggacaaggatgtaaccatcaagtgtggcattgaggagaccctcgactccaaggcccggtcggatgcggccccccggcgggagctggtactgtttgacaagcccacccggggcacctccatcaaggaattccgggagatgaccctcagcttcctcaaggcgaacctgggagacctgccttccctgccggcgctggttggccaggtcctgctcatggctgacttcaacaaggacaaccgggtgtccctggcggaagccaagtccgtgtgggccctgctgcagcgtaacgagttcctgctgctgctgtccctgcaggagaaggagcacgcctccagactgctgggctactgtggggacctctacctcaccgagggcgtgccgcatggcgcctggcacgcggccgcccttccacccctgttgcgcccactgctgccgcctgccctgcagggtgctctccagcagtggctggggcctgcgtggccttggcgggccaagatcgccatcggcctgctggagttcgtggaggagctcttccacggctcttacgggactttctacatgtgtgagaccacactggccaacgtgggctacacagccacctacgacttcaagatggccgacctgcagcaggtggcacccgaggccaccgtgcgccgcttcctgcagggccgccgctgcgagcacagcaccgactgcacctacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttgatggggcagtgaggggcctggccacccttcctggagctggccaggtgccagggtccaaccctccctcaaggaatcctgtcagaagatgtgaaatgcaactgtgttgcaaaatcactcccctaccgtcagggctctggattccagcaccacagacatgagaccccagctcggagcaaaggcggacatggacatcccggcaggagagtcctccaagggggtttgttactctgaagaacgtaatgtcaataaacagcttttatgtaatgcccagggctga

SEQ ID NO: 2281 - DNA, 1668 bp, Homo sapiens
gcatggcgagggagcggcggccgctgcgggccgggccgggccggggctgaggccgagcgagccgcggggcccgcgcagccccggccggagcccaccatgcggcggctgcggcgcctggcgcacctggtgctcttctgccccttctccaagcgcctgcagggccggctcccaggcctcagggtccgctgcatcttcctggcctggctgggcgtctttgcaggcagctggctggtgtacgtgcactactcgtcctactcggagcgctgtcgcggccatgtctgccaggtggtcatttgtgaccagtaccgcaaggggatcatctcgggctccgtctgccaggacctgtgtgagctgcatatggtggagtggaggacctgcctctcggtggccccgggccagcaggtgtacagcgggctctggcgggacaaggatgtaaccatcaagtgtggcattgaggagaccctcgactccaaggcccggtcggatgcggccccccggcgggagctggtactgtttgacaagcccacccggggcacctccatcaaggaattccgggagatgaccctcagcttcctcaaggcgaacctgggagacctgccttccctgccggcgctggttggccaggtcctgctcatggctgacttcaacaaggacaaccgggtgtccctggcggaagccaagtccgtgtgggccctgctgcagcgtaacgagttcctgctgctgctgtccctgcaggagaaggagcacgcctccagactgctgggctactgtggggacctctacctcaccgagggcgtgccgcatggcgcctggcacgcggccgcccttccacccctgttgcgcccactgctgccgcctgccctgcagggtgctctccagcagtggctggggcctgcgtggccttggcgggccaagatcgccatcggcctgctggagttcgtggaggagctcttccacggctcttacgggactttctacatgtgtgagaccacactggccaacgtgggctacacagccacctacgacttcaagatggccgacctgcagcaggtggcacccgaggccaccgtgcgccgcttcctgcagggccgccgctgcgagcacagcaccgactgcacctacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttgatggggcagtgaggggcctggccacccttcctggagctggccaggtgccagggtccaaccctccctcaaggaatcctgtcagaagatgtgaaatgcaactgtgttgcaaaatcactcccctaccgtcagggctctggattccagcaccacagacatgagaccccagctcggagcaaaggcggacatggacatcccggcaggagagtcctccaagggggtttgttactctgaagaacgtaatgtcaataaacagcttttatgtaatgcccagggctga

SEQ ID NO: 2282 - DNA, 2013 bp, Homo sapiens
gggctggccatggcgcgggcggcgggcgcgcggggccctgccgggtggtgcaggaggcgcgggcgctgcgggcggggcacgctcctcgccttcgccgcgtggaccgcgggctgggtgctggcggccgcgctgctgctccgcgcgcacccgggtgtcctctccgagcgctgcaccgacgagaagagccggcgcatcctggccgcgctgtgccaggactaccagggcggcacgctggccggggacctctgcgaggacctgtgtgtggcgggagagctgctgttccaacgctgcctgcactacaacagaggcaagaaggtgctgcaggccgactggcgcggccggcccgtggtcctcaagtccaaggaggaggccttctccagcttcccgcccctcagcctgttggaagaggaggcaggggagggtggccaggacatgcccgaggccgaactcctcctgatggtggctggggaggtcaagagcgctctgggcctggagttgtccaacagcagcctggggccgtggtggccgggcaggcggggcccacgctggcggggacagctggccagcctgtgggccctgctgcagcaggaggagtacgtctacttcagcctgctgcaggacctgagcccacacgtgctgcccgtgctgggttcctgcggccacttctacgcggtggagttcctggccgcgggcagcccccaccacagggcactcttccccctggaccgggccccaggtgcccctgggggtggccaggccaaggccatcagtgacatcgcactcagcttcttggacatggtgaaccattttgacagtgacttttcccaccgcctccacctctgcgacatcaagccggaaaactttgccatccggagcgacttcacagtggtggctattgatgtggacatggccttttttgaacctaaaatgagggaaatccttgagcaaaactgcacaggagatgaagactgcaatttctttgactgtttttcaagatgtgatttacgagtcaacaaatgcggagcgcagcgcgtaaacaacaacctgcaggtcatctgtgacaaaatatttcgccattggttttccgcgcctctcaagagctctgcggtctctttccagcttcagctgcagttacaggaggcggtgcaggaatgtgcagaccctggggtccccagtgggaacacccggagagcagcctccagcgtgttctggaagcttcgccaactcctccaagccacactgagggagctgcaggaggcagagaagtagccactctctggccttaaacatgctcacacaggaaaagtgaccttggctggatttcttctgccattgttttaaagatgagccatttcccctgtgctctctggggtgccgttctggtctccacattgtggagtggcaagtgctgctgccagagacagtgctccctcgctctcgtcccaccctggcctctgacctgtcgccttgtgtaaaatgagatgagggaggaggtacagacctcccttcaggagggctctcggtcagaagacaccaacctgtgtgcacttattctctgcagagagcacttgtacctggttatcccagcacgagttccagctgttctttcctgtaaatcgttaccacgttaaaaagtgtgcgtgtgtgcatacaaatgatgtgtatgcctgtgtctgggtgcaaatgagcatgtgagcatgtgtgagtgtgcccatgagtgtctgcatgtgtgtgagtgtgcacaggtgagtgtgcacaggtgagtgtggtgtgctcatgaggagtatgagtatgcctgagtgtgaatatgtatgagtgtgaatgagtgtgtgcacatgagtgcacgggtgtcagcatgtgtatataagtgtgggcatgtgtatgtgattgtgtgagtgtgggcaggtgagtgtgttggggatgtgggttagggtggggagtggtgctttctctagtgtgtcctccggaacatcttgcctacctagcaaagaagtgtgaccattctttcggaat

SEQ ID NO: 2283 - DNA, 3394 bp, Homo sapiens
agtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggtcataagttcctcaaccaaaaattctccttccacgagggttatgaggaaccttacccaggcagctagagaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatacaaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgtta

SEQ ID NO: 2284 - DNA, 2879 bp, Homo sapiens
catttgctatgaatattctctataacaaagcaagacaaatttagcagcacttcattgcatctggatgggggagagagctggacaatttcttgctaacaagagatggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatacaaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgtt

SEQ ID NO: 2285 - DNA, 3425 bp, Homo sapiens
aatgctgctgcctcccagagcagagggaggcagaagaggagggagggagaagagtggaagggagggggaggcggcacttgggctgcagctcgcaaccagaggcagtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatacaaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgtta

SEQ ID NO: 2286 - DNA, 3172 bp, Homo sapiens
aatgctgctgcctcccagagcagagggaggcagaagaggagggagggagaagagtggaagggagggggaggcggcacttgggctgcagctcgcaaccagaggcagtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggagaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatacaaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgtt

SEQ ID NO: 2287 - DNA, 1031 bp, Homo sapiens
cccgggagagccgggtggggcctcgggatgcagccgccggtgcccgggcccctgggcctgctggaccccgcagaagggctttcgaggaggaagaagacgtcgctctggtttgtggggtctctgctgctggtgtccgtcctcatagtcaccgtcgggctggctgccaccaccaggacggagaatgtgaccgttgggggctactacccagggatcattctcggctttggatctttcttaggaattattggcatcaacttggtggagaatagaaggcaaatgctggtggcagcgatcgtgtttatcagttttggcgtggtggccgccttctgctgcgccatcgtggacggcgtatttgcagcacagcacattgaaccgaggcccctcaccacgggaagatgccagttttactccagtggggtggggtacttgtacgatgtctaccagacagaggtcacctgtcactccctggacggcaagtgccagctgaaggtgagaagcaacacctgttactgctgtgacctctatgcctgcgggagcgcagagccctcgcccgcctactatgagttcatcggcgtcagcggctgccaggacgtgctgcacctgtaccgcctgctctgggcctctgcagttctgaacgtcctgggcctgttcctgggcatcatcaccgccgccgtcctgggggccttcaaggacatggtgcctctgtcccagctggcctatggcccagccgtcccaccacagaccctctacaaccccgcccagcagatcctggcctacgcaggcttccgcctgacgcccgagcccgtcccgacctgctcgtcctaccctctgccccttcagccctgcagccgcttcccagttgcgccctcctctgccctggcttcgtctgaggacctgcagcccccttctccaagcagctctggctctgggcttcccggccaggctccaccgtgctacgcacccacctactttcccccgggggagaagccacccccctacgcaccctgatagaggcgtggagtaaaagataa

SEQ ID NO: 2288 - DNA, 5288 bp, Homo sapiens
actcctgaccccggaaggactccgccttctccatgtcagactgctgctcagcgccaggcatcagctgggaagctggcgtgggcaggccagctgtacctggcctggagctccagattagaagaggagccatgtcagaagaaacagtaagtgaatcacagttttccttgaagacagcagcgctaagagtgtttgatcttcctctgacttggtactattctctctcccagatcaaattttctccggtggctaaaaagttgtttgtggtaactgcagtgagtgctatatctgtaatttttctggctcatcactttaaaagaaaacgtggaaagaagaaaggaaaaatattaccatgggaaccagagcacctcatacttgaatacactaaaagagcagcatcagacaaaggttcaagttgttccagtagcagacagaatttgacattatctttaagttctaccaaagacaaaggatctcaagtttgtaactatgctaatggaggacttttcagtaaatattcaggttctgcacagagtttggcctctgtccagagtgtcaattcttgtcatagctgcgcttgtggcaattctaattcctgggacaaagcagatgaagatgatattaaacttgttaatattcctgtgactactccagagaacttatacttaatgggtatggaattgtttgaagaggcattgcgtcgatgggaacaagctctgacctttcgcaatagacaggctgaagatgaagcctgtggttccattaaactgggtgcaggagatgccattgctgaagaaaatgtagatgatattattagtactgaatttatccataaactcgaagctctgctgcaaagagcctatcgtctccaagaggagtttgaagctacccttggggcatctgatcctaattcccttgctgatgatattgataaagatacagatatcaccatgaagggtaatgtggaagactttggcctgcgagacaccttgagcatcgcatccacggattcctttgcttccgcagcagagcttgcagaacacagagaagtacggcatacctacagcctggagtccctttgtcactgcccattttacgaggaagccatgcatttagttgaagaaggaaaaatttactccagagtactgagaactgaaatgttggagtgcctaggagacagtgattttcttgccaaacttcactgtattcgacaggcttttcaggtaattctttcagaatcagctaacaggatattcctcgctgagagcggaaggaaaattttatcagctttaattgtgaaagcacgaaagaatccaaagaagtttgaagatgtttttgatgaaatgatctattttttagagcagaccgatcactggggtagtactgaaatggaacttgctgctagaggggtgaaaaatctaaatttttatgatgttgttctggattttatattaatggactcctttgaagatttggaaaacccacccacatccatacagaatgtagtaaataatcgatggctaaactcatccttcaaagaaacagctgtggcttcaagttgttggtcggtgctgaaacagaaaagacaacagatgaagatcccagatggattttttgcccatttttatgccatttgtgaacacatcagtcctgtcctagcctggggctttttgggtcctagaaattctctgtatgatttatgttgcttttttaagaatcaagttcttttatttctcaaagacatttttgactttgagaaggtgcgctattcaagtacagagactttagctgaagacctcatgcagttactcattcgccgcactgagcttttaatggcctatcttgaagcagatgccctgaggcatacaagtagttgtctaagcagtcatggtcatgttatgtccactgggctactggaagccaaagtacaataagtaccataagaatcatacaatttgagtgtgctatgaaatattttaaggtaactattgattttgtaacatatattacaaagttaacagaattgatgcatgtggattcagggaggaaaaaaaaatctactaaaaaatgagcaactgtactgtatttatacagaagttctgtcattgaattcctgtgtagtgtagtcatagtggctttttgcattcattaggtaataattgaagtcatgaaatgtatattttacagaaatatcgcttgaattgaagccaatatttgggagttaattggtttgtcttcttgaagctgtcattctcaaaagctctgtttttatgctttgcacctttaaaatgtacactttagccaaggtctttgtggcccacacatgcaagaatatattacttctaatgtcaatatatttaactttgcctagaaacatatttttaattataaagttattcatttgtttaatcaagtttaggcagtaatgatgtttaatatgtactgcatacattattgcttgtgcatttgcttatgtatttgaatcaaagaaattgtaatcactgaatattgttatagaacatttaaatgggccacttgcagtggctcatgcctgtaatacattgggaggctgaggcaggaggacagtttgaggccaggaggttgagactagcctggacaacataaggagatgcctgtctctacaaaaacataaaaataaattagctggtatcaagcagagttccatggaaatattaaaatttttttaaaaaataaaaataggctgggtgtggtggttcatgcctgtaatcctagcactttgggaggccaaggtgggcggatcacctgaggtcaggtgttcgagaccagcctccccaatatggtgaaaccccgtctctactaaaaatacaaaaattagccaggtgtggtggcgggcgcctgtagtcccagctactcgggaggctgacacaggagtattgcttgaacccaggaagtggaggctgcagtgagccgagatcgcaccactgcactccagcctgggcaacaaagtgagactctgtctcaaaaaataaattaattaaattaaattaattagttgggtgtggtggcatgtgtctgtggtcccagctacttgggaggctgaggtgggaggatcacttgagtccagaaggtcaaggctgtcatgagctgtgattgcatcactgcactccagcctgggcgacagcaagaccctatctcagaagtgaataaataaaacaaatacagcatttaaatgaattgacattgagaaatttacaatttacaaatttatattaactgtagtttccaaaatatgttactgttggtcctgtaagttacaaagagactgaagaactttctttttatacattagagcattttcccctggaatgagtattgattaaaaagataacatttattaattaataaaggcaatttaaaatttagtgttatttgaagactgtcaacatctgaaggtatgaaacttggtacagtgaaataatttctcctttctccttccttttagttattcccacagaaaactcagcccagtgggaatttgtcatattatgcccatgttttaaaaatattcatagtttgaatcttattgacattttaaagaagagttttttcctccctggaatgtaaaacaaaaatattttttaatgatgtggaagtatatatttcatgttcattatgataaatctacaaacaaatgaattgtttttatgggtggagttcttctataagagtatattaaatgctttcagagttgtattaattttgtttctaaataatataccacttatttggagtgactaactcagtatgtaagtagatgagatttgttgattttgcccctaaaacgggctttagtcattttaggagtgagttgcacaaaaggacctaaaatgcattgttttttgccttcttttaagagatggggtctcgctctattgcccaggctggagtgcagtgtgctatcatacatagctcactgcagtctccaactcctcataccagaggcatgtgtcaccatgtcttactcctaaaatgcatttttaaaaagcgaatttttagattaaagtgcctagtttctgattaataaatagaagatgaaaaaagtgggcgggaaaagcataatcttttaagatttgtaattttctgtatgtgccacatttatgtaaattaactataaaatatggaattcaggatcatgctgttttgcatgtactttataggttatatagcatgaaacatacaaattatcactgttctttagtatatagctccttgccttttcttacatagatgcttaatttaacaattacctatttatagttcttattattgacgggaatatgattagaagtaccaaaactaaaaattccattatgtactgtttactttttatttaatattacatgtttttaccttgttgcggtatctttggccttcacacacacatgtgtgcgtgcacgtgcatttcattaccatgtagacaagacagttattgcttatagtaatttacccatttgagggctaagtgttttaagctgtggttttataagcaaagctgtaagtaaatgtaatttattttagaaagatattatttgaaatcaattttgaagaattgcactatttgataatgctgctactacatgagataactctggggaattaattttatgagataagatgaatggctttctagaaggtgttgctttttgttttttctttttcttttttacatttcatcttagaaaaagttgcttatattcagcaggttggtttgtcaaattcagtgtttgagtttgtttctggtcagttcagtagctgctactttagcaagatgtggcctttcacaaaagaggtaagagtgaccaaatagaattttaggacaataagtataggaaatatctctttatcgtaagataagaaacttgaactttttaaaggaaatgtcctcttgaaaagaacatttctgactgcatgcagaagggtacttaagacatatataacaggccaggagcagtggctcacgcctgtaatcccagcactttgggaggcccaagtgggcagataacctgaggtcaggagtttgagaccagcctgaccaacatggtgaaaccccatctctactaaaaatacaaaaattagccaggcatggtggcgcatgcctgtaatcccagctactcgagaggctgaggcaggagaatcgcttgaacccgggaggcggaggttgcagttagccgagatcgtgccattgcactccagcctgggcaacaagagtaaaactctgtctcaaaaaaaaaaaaaaaaaaaaaaaaaaa

SEQ ID NO: 2289 - DNA, 1871 bp, Homo sapiens
cttctccatgtcagactgctgctcagcgccaggcatcagctgggaagctggcgtgggcaggccagctgtacctggcctggagctccagatcaaattttctccggtggctaaaaagttgtttgtggtaactgcagtgagtgctatatctgtaatttttctggctcatcactttaaaagaaaacgtggaaagaagaaaggaaaaatattaccatgggaaccagagcacctcatacttgaatacactaaaagagcagcatcagacaaaggttcaagttgttccagtagcagacagaatttgacattatctttaagttctaccaaagacaaaggatctcaagtttgtaactatgctaatggaggacttttcagtaaatattcaggttctgcacagagtttggcctctgtccagagtgtcaattcttgtcatagctgcgcttgtggcaattctaattcctgggacaaagcagatgaagatgatattaaacttgttaatattcctgtgactactccagagaacttatacttaatgggtatggaattgtttgaagaggcattgcgtcgatgggaacaagctctgacctttcgcaatagacaggctgaagatgaagcctgtggttccattaaactgggtgcaggagatgccattgctgaagaaaatgtagatgatattattagtactgaatttatccataaactcgaagctctgctgcaaagagcctatcgtctccaagaggagtttgaagctacccttggggcatctgatcctaattcccttgctgatgatattgataaagatacagatatcaccatgaagggtaatgtggaagactttggcctgcgagacaccttgagcatcgcatccacggattcctttgcttccgcagcagagcttgcagaacacagagaagtacggcatacctacagcctggagtccctttgtcactgcccattttacgaggaagccatgcatttagttgaagaaggaaaaatttactccagagtactgagaactgaaatgttggagtgcctaggagacagtgattttcttgccaaacttcactgtattcgacaggcttttcaggtaattctttcagaatcagctaacaggatattcctcgctgagagcggaaggaaaattttatcagctttaattgtgaaagcacgaaagaatccaaagaagtttgaagatgtttttgatgaaatgatctattttttagagcagaccgatcactggggtagtactgaaatggaacttgctgctagaggggtgaaaaatctaaatttttatgatgttgttctggattttatattaatggactcctttgaagatttggaaaacccacccacatccatacagaatgtagtaaataatcgatggctaaactcatccttcaaagaaacagctgtggcttcaagttgttggtcggtgctgaaacagaaaagacaacagatgaagcagatcccagatggattttttgcccatttttatgccatttgtgaacacatcagtcctgtcctagcctggggctttttgggtcctagaaattctctgtatgatttatgttgcttttttaagaatcaagttcttttatttctcaaagacatttttgactttgagaaggtgcgctattcaagtacagagactttagctgaagacctcatgcagttactcattcgccgcactgagcttttaatggcctatcttgaagcagatgccctgaggcatacaagtagttgtctaagcagtcatggtcatgttatgtccactgggctactggaagccaaagtacaataagtaccataagaatcatacaatttgagtgtgctatgaaatattttaaggtaactattgattttgtaacatatattac

SEQ ID NO: 2290 - DNA, 3707 bp, Homo sapiens
ggagcaggcgtgcgggccgtgagcggcgccagagggtacctggctctgtggaggggccctctggtatgtgtgtccctgtccttctggggcgtggatggtgcctgggacccagctggcaaccagttgaagacgttctccttggaagctcttggccctgaggactttgcctggggcattggccctgccatggcgttccggagggccgagggcacgtctatgatccaggccctggccatgacggtggccgagatccccgtgttcctgtacacgacgtttgggcagtctgcattctcccagctacggttgacgccaggcctgcggaaagtcctctttgccacggccctggggactgtggccctggccctggctgcccaccagctgaagaggcgacggaggaggaagaagcaggttggtcccgagatgggaggggagcagctgggcacggtgcccctccctatcctcttggccaggaaggtcccttcagtgaagaaaggatactccagccggagagtccagagccccagcagcaagagcaacgacaccctgagtggcatctcttccattgagcccagcaagcactcgggctcctcccacagtgtggcctcgatgatggcagtgaactcatccagccccacagccgcgtgctcgggactatgggatgccagagggatggaggagtctctgaccaccagcgacggcaatgcagagagcctgtacatgcaaggcatggagctgtttgaggaagctctgcagaagtgggagcaggcactaagcgtgggccagcggggggacagcggcagcacccccatgcccagggacggcctccggaacccagagactgcatcagagccactgtctgagacggagtctcactctgttgccaggctggagtgcagtggcgcgatctcggctcagtgcaacctccgcttcctgggttcaagagattctcctgcctcagcctcccaagtagctgggattacagccagagtcacagcggaaggagtttgcagagaagctggagtccctgctgcaccgtgcctaccacctgcaggaggagttcggctccaccttccccgcagacagcatgctgctagacctcgagaggaccctcatgctgcccctgaccgagggctcgctgcggctgcgggcggacgatgaggacagcctgacttcagaggattccttcttctccgccaccgagctctttgagtccctgcagactggagattacccgatcccactctccagacccgccgctgcctatgaggaggccctgcagctggtgaaggaggggagagtgccttgccggaccctcaggacggagctgctgggctgctacagtgaccaggactttctggccaagctgcactgtgtgcggcaggccttcgaggggcttctggaagacaagagtaaccagcttttcttcgggaaagtgggccgacagatggtgacaggcctgatgaccaaggctgagaagagccccaaaggcttcctggagagctacgaggagatgctgagctatgccctgcggcccgagacctgggccacaacacggctggagctggagggccgaggggtggtatgcatgagcttcttcgacatcgtgctggacttcatcctcatggacgccttcgaggacctggagaaccctccggcctcggtgctcgccgtcctgcggaaccgctggctgtcagacagcttcaaggagacggccttggccactgcttgctggtcggtcctgaaagccaagaggaggctgctgatggtgcctgatggcttcatctcccatttctactccgtatcggagcatgtgagccctgtcctagccttcggcttccttggacccaagcctcagcttgctgaagtctgtgctttcttcaagcaccagattgtgcagtacctgagggacatgttcgacctggacaatgtgcgctacacgtcactgcccgcgctggcagacgacatcctgcagctgtcccggcgccgcagcgagatattgctggggtacctgggggtgcccgcggccagcagcgcaggcgtgaatggggcgctgccccgagagaatgggcccctgggggagctgcagtagaggcggcacgggctggggggtggcagagagaaggctcctcctcccttccctgggttggtatctgacagctgtggtggctgagggccgttgcccctgactttgccccacccccatcatctgggagtccccaaggcccagaggggacatttccatggagaagaacggttcctgggggaagcagaggccaggaccagtggggcctgtgggagagaaaggctgtgagagagggggttgttgtggagaattgggacaggcagagccaggatgccccaggtgggggaccccaaaacctcccatcgctccagggctgctgacaagggtgctgggagggtggaggtgaaggatggggcctagagccctgtggtgaaggtcacagtgtcctgagctagaagccacctgtggctatatggtctcagcatccagctggcctgtcctgatgccctccccacctcaaccgccttctcagagagtttgcaactccagagaaggagagtggggccaccttagtgggcagcaggcctgggccatccagagatggggcagaggtgggcctcccactcctgtgctctcttctgagcaggaactgggcccttgacagtgtcctttgacattccctcgccctaccaaagatcgtcttttctcctcccacctctgtcaccaccaaagacgggcggaggtggggctgggccctcctgcccccgcccatcccccttccatgagcccagacctccctgggtggtgctaggctctgagctgggggctcagaccagggatcgctcaggcccctgtcacctgtgggcccggggaccacttgggggaggtcagaggatgtatgtggccggaccagcttccccaccttcattaggacaagaaactgcccagcactttgccttcagttcaacgcacaaacgctcctggggcctcatgggggcagagcctcccctgggcctgcagagagtcctgttagcagcgacgtccccccgccgcggggtcctgtcagcccggcagtgtcttctcagtgtcttcacctgagcgagtgtctgtggccccaacgcgttctgctgtggctctgccctttccaggttgagaggcctgcaggagaaacacactcccctcctgggtttccacactcaggaggtcagaggactggctcctgtgaccagggcccctctcccctgaatgggaaaggggtctggggatgggagggcgcaccacagagaggagatgatgctgggtgtggcccatcttctgtgggccccttcccagacaccggatccatgggcactaacccgcctcccaggctgatgcccggaggcagcttcctgggcaggagggttccatgggcactaacccacctcccaggctgatgcctggaggcagcctccagggcaggaaggaccctgtgctccccgccccccatcctgacatcctgttcttttgcacttaccctgtgctgtgaatgtaacagtgggccttggccccgcccactctgatttgcattttcatttgtgtttgtttacacatccatgcactgcctgtagcagtcgattgtcacagcttcgacttttggatggtagagtgtgtgcactgactgtgagtcgaataaacaattgagacg

SEQ ID NO: 2291 - DNA, 3637 bp, Homo sapiens
aggtacccgatccgaggcggggagagcacccgggatggaaggagcaggcgtgcgggccgtgagcggcgccagagggtacctggctctgtggaggggccctctggtatgtgtgtccctgtccttctggggcgtggatggtgcctgggacccagctggcaaccagttgaagacgttctccttggaagctcttggccctgaggactttgcctggggcattggccctgccatggcgttccggagggccgagggcacgtctatgatccaggccctggccatgacggtggccgagatccccgtgttcctgtacacgacgtttgggcagtctgcattctcccagctacggttgacgccaggcctgcggaaagtcctctttgccacggccctggggactgtggccctggccctggctgcccaccagctgaagaggcgacggaggaggaagaagcaggttggtcccgagatgggaggggagcagctgggcacggtgcccctccctatcctcttggccaggaaggtcccttcagtgaagaaaggatactccagccggagagtccagagccccagcagcaagagcaacgacaccctgagtggcatctcttccattgagcccagcaagcactcgggctcctcccacagtgtggcctcgatgatggcagtgaactcatccagccccacagccgcgtgctcgggactatgggatgccagagggatggaggagtctctgaccaccagcgacggcaatgcagagagcctgtacatgcaaggcatggagctgtttgaggaagctctgcagaagtgggagcaggcactaagcgtgggccagcggggggacagcggcagcacccccatgcccagggacggcctccggaacccagagactgcatcagagccactgtctgagccagagtcacagcggaaggagtttgcagagaagctggagtccctgctgcaccgtgcctaccacctgcaggaggagttcggctccaccttccccgcagacagcatgctgctagacctcgagaggaccctcatgctgcccctgaccgagggctcgctgcggctgcgggcggacgatgaggacagcctgacttcagaggattccttcttctccgccaccgagctctttgagtccctgcagactggagattacccgatcccactctccagacccgccgctgcctatgaggaggccctgcagctggtgaaggaggggagagtgccttgccggaccctcaggacggagctgctgggctgctacagtgaccaggactttctggccaagctgcactgtgtgcggcaggccttcgaggggcttctggaagacaagagtaaccagcttttcttcgggaaagtgggccgacagatggtgacaggcctgatgaccaaggctgagaagagccccaaaggcttcctggagagctacgaggagatgctgagctatgccctgcggcccgagacctgggccacaacacggctggagctggagggccgaggggtggtatgcatgagcttcttcgacatcgtgctggacttcatcctcatggacgccttcgaggacctggagaaccctccggcctcggtgctcgccgtcctgcggaaccgctggctgtcagacagcttcaaggagacggccttggccactgcttgctggtcggtcctgaaagccaagaggaggctgctgatggtgcctgatggcttcatctcccatttctactccgtatcggagcatgtgagccctgtcctagccttcggcttccttggacccaagcctcagcttgctgaagtctgtgctttcttcaagcaccagattgtgcagtacctgagggacatgttcgacctggacaatgtgcgctacacgtcactgcccgcgctggcagacgacatcctgcagctgtcccggcgccgcagcgagatattgctggggtacctgggggtgcccgcggccagcagcgcaggcgtgaatggggcgctgccccgagagaatgggcccctgggggagctgcagtagaggcggcacgggctggggggtggcagagagaaggctcctcctcccttccctgggttggtatctgacagctgtggtggctgagggccgttgcccctgactttgccccacccccatcatctgggagtccccaaggcccagaggggacatttccatggagaagaacggttcctgggggaagcagaggccaggaccagtggggcctgtgggagagaaaggctgtgagagagggggttgttgtggagaattgggacaggcagagccaggatgccccaggtgggggaccccaaaacctcccatcgctccagggctgctgacaagggtgctgggagggtggaggtgaaggatggggcctagagccctgtggtgaaggtcacagtgtcctgagctagaagccacctgtggctatatggtctcagcatccagctggcctgtcctgatgccctccccacctcaaccgccttctcagagagtttgcaactccagagaaggagagtggggccaccttagtgggcagcaggcctgggccatccagagatggggcagaggtgggcctcccactcctgtgctctcttctgagcaggaactgggcccttgacagtgtcctttgacattccctcgccctaccaaagatcgtcttttctcctcccacctctgtcaccaccaaagacgggcggaggtggggctgggccctcctgcccccgcccatcccccttccatgagcccagacctccctgggtggtgctaggctctgagctgggggctcagaccagggatcgctcaggcccctgtcacctgtgggcccggggaccacttgggggaggtcagaggatgtatgtggccggaccagcttccccaccttcattaggacaagaaactgcccagcactttgccttcagttcaacgcacaaacgctcctggggcctcatgggggcagagcctcccctgggcctgcagagagtcctgttagcagcgacgtccccccgccgcggggtcctgtcagcccggcagtgtcttctcagtgtcttcacctgagcgagtgtctgtggccccaacgcgttctgctgtggctctgccctttccaggttgagaggcctgcaggagaaacacactcccctcctgggtttccacactcaggaggtcagaggactggctcctgtgaccagggcccctctcccctgaatgggaaaggggtctggggatgggagggcgcaccacagagaggagatgatgctgggtgtggcccatcttctgtgggccccttcccagacaccggatccatgggcactaacccgcctcccaggctgatgcccggaggcagcttcctgggcaggagggttccatgggcactaacccacctcccaggctgatgcctggaggcagcctccagggcaggaaggaccctgtgctccccgccccccatcctgacatcctgttcttttgcacttaccctgtgctgtgaatgtaacagtgggccttggccccgcccactctgatttgcattttcatttgtgtttgtttacacatccatgcactgcctgtagcagtcgattgtcacagcttcgacttttggatggtagagtgtgtgcactgactgtgagtcgaataaacaattgagacgatttccttcca

SEQ ID NO: 2292 - DNA, 3426 bp, Homo sapiens
ggagcaggcgtgcgggccgtgagcggcgccagagggtacctggctctgtggaggggccctctggtatgtgtgtccctgtccttctggggcgtggatggtgcctgggacccagctggcaaccagttgaagacgttctccttggaagctcttggccctgaggactttgcctggggcattggccctgccatggcgttccggagggccgagggcacgtctatgatccaggccctggccatgacggtggccgagatccccgtgttcctgtacacgacgtttgggcagtctgcattctcccagctacggttgacgccaggcctgcggaaagtcctctttgccacggccctggggactgtggccctggccctggctgcccaccagctgaagaggcgacggaggaggaagaagcaggttggtcccgagatgggaggggagcagctgggcacggtgcccctccctatcctcttggccaggaaggtcccttcagtgaagaaaggatactccagccggagagtccagagccccagcagcaagagcaacgacaccctgagtggcatctcttccattgagcccagcaagcactcgggctcctcccacagtgtggcctcgatgatggcagtgaactcatccagccccacagccgcgtgctcgggactatgggatgccagagggatggaggagtctctgaccaccagcgacggcaatgcagagagcctgtacatgcaaggcatggagctgtttgaggaagctctgcagaagtgggagcaggcactaagcgtgggccagcggggggacagcggcagcacccccatgcccagggacggcctccggaacccagagactgcatcagagccactgtctgagccagagtcacagcggaaggagtttgcagagaagctggagtccctgctgcaccgtgcctaccacctgcaggaggagttcggctccaccttccccgcagacagcatgctgctagacctcgagaggaccctcatgctgcccctgaccgagggctcgctgcggctgcgggcggacgatgaggacagcctgacttcagaggattccttcttctccgccaccgagctctttgagtccctgcagactggagattacccgatcccactctccagacccgccgctgcctatgaggaggccctgcagctggtgaaggaggggagagtgccttgccggaccctcagagccccaaaggcttcctggagagctacgaggagatgctgagctatgccctgcggcccgagacctgggccacaacacggctggagctggagggccgaggggtggtatgcatgagcttcttcgacatcgtgctggacttcatcctcatggacgccttcgaggacctggagaaccctccggcctcggtgctcgccgtcctgcggaaccgctggctgtcagacagcttcaaggagacggccttggccactgcttgctggtcggtcctgaaagccaagaggaggctgctgatggtgcctgatggcttcatctcccatttctactccgtatcggagcatgtgagccctgtcctagccttcggcttccttggacccaagcctcagcttgctgaagtctgtgctttcttcaagcaccagattgtgcagtacctgagggacatgttcgacctggacaatgtgcgctacacgtcactgcccgcgctggcagacgacatcctgcagctgtcccggcgccgcagcgagatattgctggggtacctgggggtgcccgcggccagcagcgcaggcgtgaatggggcgctgccccgagagaatgggcccctgggggagctgcagtagaggcggcacgggctggggggtggcagagagaaggctcctcctcccttccctgggttggtatctgacagctgtggtggctgagggccgttgcccctgactttgccccacccccatcatctgggagtccccaaggcccagaggggacatttccatggagaagaacggttcctgggggaagcagaggccaggaccagtggggcctgtgggagagaaaggctgtgagagagggggttgttgtggagaattgggacaggcagagccaggatgccccaggtgggggaccccaaaacctcccatcgctccagggctgctgacaagggtgctgggagggtggaggtgaaggatggggcctagagccctgtggtgaaggtcacagtgtcctgagctagaagccacctgtggctatatggtctcagcatccagctggcctgtcctgatgccctccccacctcaaccgccttctcagagagtttgcaactccagagaaggagagtggggccaccttagtgggcagcaggcctgggccatccagagatggggcagaggtgggcctcccactcctgtgctctcttctgagcaggaactgggcccttgacagtgtcctttgacattccctcgccctaccaaagatcgtcttttctcctcccacctctgtcaccaccaaagacgggcggaggtggggctgggccctcctgcccccgcccatcccccttccatgagcccagacctccctgggtggtgctaggctctgagctgggggctcagaccagggatcgctcaggcccctgtcacctgtgggcccggggaccacttgggggaggtcagaggatgtatgtggccggaccagcttccccaccttcattaggacaagaaactgcccagcactttgccttcagttcaacgcacaaacgctcctggggcctcatgggggcagagcctcccctgggcctgcagagagtcctgttagcagcgacgtccccccgccgcggggtcctgtcagcccggcagtgtcttctcagtgtcttcacctgagcgagtgtctgtggccccaacgcgttctgctgtggctctgccctttccaggttgagaggcctgcaggagaaacacactcccctcctgggtttccacactcaggaggtcagaggactggctcctgtgaccagggcccctctcccctgaatgggaaaggggtctggggatgggagggcgcaccacagagaggagatgatgctgggtgtggcccatcttctgtgggccccttcccagacaccggatccatgggcactaacccgcctcccaggctgatgcccggaggcagcttcctgggcaggagggttccatgggcactaacccacctcccaggctgatgcctggaggcagcctccagggcaggaaggaccctgtgctccccgccccccatcctgacatcctgttcttttgcacttaccctgtgctgtgaatgtaacagtgggccttggccccgcccactctgatttgcattttcatttgtgtttgtttacacatccatgcactgcctgtagcagtcgattgtcacagcttcgacttttggatggtagagtgtgtgcactgactgtgagtcgaataaacaattgagacg

SEQ ID NO: 2293 - DNA, 563 bp, Homo sapiens
agcggcgccagagggtacctgggctggagcgcagtggccccatcttggctcactgccacctccacctcccaggttcaagccggttctcctgcttcagcctcttgagtagctgggattacagctctgtggaggggccctctggtatgtgtgtccctgtccttctggggcgtggatggtgcctgggacccagctggcaaccagttgaagacgttctccttggaagctcttggccctgaggactttgcctggggcattggccctgccatggcgttccggagggccgagggcacgtctatgatccaggccctggccatgacggtggccgagatccccgtgttcctgtacacgacgtttgggcagtctgcattctcccagctacggttgacgccaggcctgcggaaagtcctctttgccacggccctggggactgtggccctggccctggctgcccaccagctgaagaggcgacggaggaggaagaagcaggttggtcccgagatgggaggggagcagctgggcacggtgcccctccctatcctcttggccaggaaggtcccttcagt

SEQ ID NO: 2294 - DNA, 1652 bp, Homo sapiens
aacaaaagcagggtagggctccagctaagccacgtaggcactacgatgggcaacagaaaggttggtttctgggcaattcagagaaaccaaggacagctacccccagaactcagagtagccaactgggctgctcacaggagatgccttaactgaaaggtgatcagactccacaggagacccagagaagatgtggagggagctcagaggctgtcctggaggagacgtggagacagctcagaggctgtcccagagaagacgtggaaagagctcagaggctgtcccagagaagacgtggagagctcagaggatgtcccagagaagacgtggagagagttcagaggctgtcccggagaagacgtggaaagagctcagaaactcagagactgtcccggagaagacatggaaacagctcagacgctgtctgcaagaagatgtggagagagttcagaggctgtcgttactgctgcacttggctgtttttctttggataattattgcaatcaattttagtaattcaggtgttaaatcacagtcaagcacctatttacctagtggtaaaatccttaagtaagtcatatttggttgggaagatcaaagaaatcacccagtctcccacatccgaaattgtgcagtccggactgtcaggaacaaaagtgaaagagagacgtcatcaaggccgggcgcggtggctcatgcctgtaatcccagcactttggaaggccaaggagggcggatcatgaggtcaggagttcaagaccagcctggccaatatggtgaaaccctgtctctactaaaaatacaaaaattagccaggcgtggtggcaggcgcctgtaatcccagctacttgggaggctgaggcagaagaatcacttgaacctgagaggcagaggttgcaataagccaagattgtgccattgcactccagcctgggagacaaagcgagactccatctcaaaaaaaaaaaaaaaaaaaaaagaatgactaaaattaagaagattgatgattccaaatattagtaaagatgtagaacaactagaactcccacatattgctgatgaaaatgaagaataatacattactttggaaaatactttggtactgatttaccatatgaccccaaaatctcacttgtagaaatttatacaggaaaaatgaaaacatatgctcacagaaagcttgtatacacatgcttatggcaataaatttatttatagttgcctaccaacaagtgatgaacaaatatattttagtatcttgatactactttctagctagaaaaggaatactactaagcaaaaatagaggatgaagtagtaatatacataacatagatgaatttaaaaacaccatgctgattgaaagaaaacaattatcaaatacacagtgtaatattctattcacagaaagtttgaaaacaaaaaactatagtctctgaaagaaaaccattggttgcaggaaggtggggattcattggccacaaaagggactgaggaaactttttatgggtaatggaaatattttatatcttgattgtggcaccaattatacaactatatgtacacatttgtcaaaattctaattgtattatacacaacatgagtgactttaactgtctataaattatatctcaataaaattggtcttaaaagat

SEQ ID NO: 2295 - DNA, 1652 bp, Homo sapiens
aacaaaagcagggtagggctccagctaagccacgtaggcactacgatgggcaacagaaaggttggtttctgggcaattcagagaaaccaaggacagctacccccagaactcagagtagccaactgggctgctcacaggagatgccttaactgaaaggtgatcagactccacaggagacccagagaagatgtggagggagctcagaggctgtcctggaggagacgtggagacagctcagaggctgtcccagagaagacgtggaaagagctcagaggctgtcccagagaagacgtggagagctcagaggatgtcccagagaagacgtggagagagttcagaggctgtcccggagaagacgtggaaagagctcagaaactcagagactgtcccggaaaagacatggaaacagctcagacgctgtctgcaagaagatgtggagagagttcagaggctgtcgttactgctgcacttggctgtttttctttggataattattgcaatcaattttagtaattcaggtgttaaatcacagtcaagcacctatttacctagtggtaaaatccttaagtaagtcatatttggttgggaagatcaaagaaatcacccagtctcccacatccgaaattgtgcagtctggactgtcaggaacaaaagtgaaagagagacgtcatcaaggccgggcgcggtggctcatgcctgtaatcccagcactttggaaggccaaggagggcggatcatgaggtcaggagttcaagaccagcctggccaatatggtgaaaccctgtctgtctctactaaaaatacaaaaattagccaggcgtggtggcaggcacctgtaatcccagctacttgggaggctgaggcagaagaatcacttgaacctgagaggcagaggttgcaataagccaagattgtgccattgcactccagcctgggagacaaagcgagactccatctcaaaaaaaaaaaaaaaaaaaagaatgactaaaattaagaagattgatgattccaaatattggtaaagatgtagaacaactagaactcccacatattgctgatgaaaatgaagaataatacattactttggaaaatactttggtacatttaccatatgaccccaaaatctcacttgtagaaatttatacaggaaaaatgaaaacatatgctcacagaaagcttgtatacacatgcttatggcaataaatttatttatagttgcctatcaacaagtgatgaacaaatatattttagtatcttgatactactttctagctagaaaaggaatactactaagcaaaaatagaggatgaagtagtaatatacataacatatatgaatttaaaaacaccatgctgattgaaagaaaacaattatcaaatacacagtgtaatattctattcacagaaagtttgaaaacaaaaaactatagtctctgaaagaaaaccattggttgcaggaaggtggggattcattggccacaaaagggactgaggaaactttttatgggtaatggaaatattttatatcttgatggtggcaccaattatacaactgtatgtacacatttgtcaaaattctaatcgtattatacacaacatgagtgactttaactgtctataaattatatctcaataaaattggtcttaaaagat

SEQ ID NO: 2296 - DNA, 4223 bp, Homo sapiens
agttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaagtgtccagtagggcggaggcggaggcccagaggcaggatgaaaaaccacagtctgagagctggtagagagtgcccgagaggcctgcaggagacttcggacctgctttcacaactgcagagcctcctggggccacaccttgacaaaggtgactttggtcagctctccggtccagaccccccaggtgaagtgggcgaaagagcacctgatggagcctcccagtcctctcatgagcctatggaagatgctgctcccattctctccccgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctccgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctaccagatggaagctggtagcctgtttttgctcagctctgatggccagaatgccgtggggatacaagtcacagaaacagccaaggtcaacatttgggaagaaaaagaaaatgttggatcatttacagatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccccgtcccatctggggcccgagtgccaaccctttatttcatccacaccccaattccggcccacacctatggctcaggccgaggctcaggcccatcttcaatcttctttcccagtcctatctcctgcttttccatccctgattaagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggacatgaaaagcttcccacggaaggttctgggggtgacttctgaggagtcggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgggcccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatatgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctgctgggaacatgcgggcttcccaggagctacatgaccttatggcagccagaaggagcaaactggtgcacgaggagcccagaaacccaaactgtcaaggctcatgcaagaaccaaaggccaatgtttccccctattcacaagagtgagaagtctaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagccactttggaggaaacatcaagcaattttttcagtggattttttcaaagaaaaaaagcaagccagcaccagtcactgctgagagccaaaaaacagtgaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacaggcaaatcagaaatcaacagcccttgaaaagtgtgcggtgcaacaatgagcaatggggcctgcgacatccccaaatcttgcaccccaagaaagctgtatccccagtcagtccccttcagcactggccgaagacatccggtgcctctagccaccatcaccactgtccaaggcactgtcttctttgggaaggtatctgatttggtcagtcacaaattcttttttagccttccctggagaaaaagaagtccccaagaaaaaattcactctatgtagagaaaaaatattttctctcatgttagtacatgcagaacatttaatataccacaatatatatggttttttattca

SEQ ID NO: 2297 - DNA, 4226 bp, Homo sapiens
agttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaagtgtccagtagggcggaggcggaggcccagaggcaggatgaaaaaccacagtctgagagctggtagagagtgccggagaggcctgcaggagacttcggacctgctttcacaactgcagagcctcctggggccacaccttgacaaaggtgactttggtcagctctccggtccagaccccccaggtgaagtgggcgaaagagcacctgatggagcctcccagtcctctcatgagcctatggaagatgctgctcccattctctccccgttagcttccccagatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctccgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctaccagatggaagctggtagcctgtttttgctcagctctgatggccagaatgccgtggggatacaagtcacagaaacagccaaggtcaacatttgggaagaaaaagaaaatgttggatcatttacagatcgaatgaccccagaaaagcacttaaattctttgcggaatttggctaaatcattggatgctgagcaggacaccacaaacccaaaacccttctggaacatgggagagaactcgaaacagctgcccggacctcagaagttctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccccgtcccatctggggcccgagtgccaaccctttatttcatccacaccccaattccggcccacacctatggctcaggccgaggctcaggcccatcttcaatcttctttcccagtcctatctcctgcttttccatccctgattaagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggacatgaaaagcttcccacggaaggttctgggggtgacttctgaggagtcggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgggcccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatatgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgaccttatggcagccagaaggagcaaactggtgcacgaggagcccagaaacccaaactgtcaaggctcatgcaagagccaaaggccaatgtttccccctattcacaagagtgagaagtctaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagccactttggaggaaacatcaagcaattttttcagtggattttttcaaagaaaaaaagcaagccagcaccagtcactgctgagagccaaaaaacagtgaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacaggcaaatcagaaatcaacagcccttgaaaagtgtgcggtgcaacaatgagcaatggggcctgcgacatccccaaatcttgcaccccaagaaagctgtatccccagtcagtccccttcagcactggccgaagacatccggtgcctctagccaccatcaccactgtccaaggcactgtcttctttgggaaggtatctgatttggtcagtcacaaattcttttttagccttccctggagaaaaagaagtccccaagaaaaaattcactctatgtagagaaaaaatattttctctcatgttagtacatgcagaacatttaatataccacaatatatatggttttttattcataa

SEQ ID NO: 2298 - DNA, 4223 bp, Homo sapiens
agttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaagtgtccagtagggcggaggcggaggcccagaggcaggatgaaaaaccacagtctgagagctggtagagagtgccggagaggcctggaggagacttcggacctgctttcacaactgcagagcctcctggggccacaccttgacaaaggtgactttggtcagctctccggtccagaccccccaggtgaggtgggcgaaagagcacctgatggagcctcccagtcctctcatgagcctatggaagatgctgctcccattctctccctgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctctgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctgtcagatggaagctggtagcctgtttttgctcagctctgatggccagaatgtcgtggggatacaagtcacagaaacagccaaggtcaacatttgggaagaaaaagaaaatgttggatcatttacaaatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccatctggggcccgagtgccaaccctttatttcatccacaccccaattccggcccacacctatggctcaggccgaggctcaggcccatcttcaatcttctttcccagtcctatctcctgcttttccatccctgattcagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcaggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggatatgaaaagcttcccacggaaggttctgggggtgacttctgaggagttggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgaacccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttagtgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcacgaggagcccagaaaaccaaactgtcaaggctcatgcaagagccaaaggccaatgtttccccctattcacaagagtgagaagtttaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagcccctttggagaaaacatcaagcaaatttttcagtggattttttcaaagaaaaaaagcaagccagcaccagtcactgctgagagccaaaaaacagtaaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacagacaaatcagaaatcaacagcccttgaaaagtgtgcggtgcaacaatgagcaatggggcctgcgacatccccaaatcttgcaccccaagaaagctgtatccccagtcagtccccctcagcactggccgaagacatccggtgcctctagccaccatcaccactgtccaaggcactgtcttctttgggaaggtatctgatttggtcagtcacaaattcttttttagccttccctggagaaaaacaagtccccaagaaaaaattcactctatgtagagaaaaaatattttctctcatgttagtacatgcagaacatttaatattccacaatatatatggttttttattca

SEQ ID NO: 2299 - DNA, 4226 bp, Homo sapiens
agttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcgtattactcccctacttatcttacttccgttgtgatgacccaccctcaccatcgcctgggaagagaaagtgtccagtagggcggaggcggaggcccagaggcaggatgaaaaaccacagtctgagagctggtagagagtgccggagaggcctggaggagacttcggacctgctttcacaactgcagagcctcctggggccacaccttgacaaaggtgactttggtcagctctccggtccagaccccccaggtgaggtgggtgaaagagcacctgatggagcctcccagtcctctcatgagcctatggaagatgctgctcccattctctccccgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctctgcctcctccaaaaggcttcactgctcctcccctgcgggactccacactgataactccatctcactgtgactcagtggcatttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctgtcagatggaagctggtagcctgtttttgctcagctctgatggccagaatgtcgtggggatacaagtcacagaaacagccaaggtcaacatttgggaagaaaaagaaaatgttggatcatttacaaatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccatctggggcccgagtgccaaccctttatttcatccacaccccaattccggcccacacctatggctcaggccgaggctcaggcccatcttcaatcttctttcccagtcctatctcctgcttttccatccctgattcagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggatatgaaaagcttcccacggaaggttctgggggtgacttctgaggagttggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgttgaccaaagcatctgatcacatgccagagagtcttctggcctcctcacctgcatggaagcagttccagagggcaccgcgaggaatcccatcttggaatgatcatgaacccttgaagcctcctccagctggacaggagggcaggtggccatctaagcccctcacgtacagcctcacaggcagcatccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgctgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcacgaggagcccagaaacccaaactgtcaaggctcatgcaagagccaaaggccaatgtttccccctattcacaagagtgagaagtctaggaaacccaacttagaaaaacatgaagaaaggcttgaaggattgaggactcctcaacttaccccagtcaggaaaacagaagacacccatcaggatgaaggcgtccagctactgccatcaaagaaacagcctccttcagtaagcccctttggagaaaacatcaagcaaatttttcagtggattttttcaaagaaaaaaagcaagccagcaccagtcactgctgagagccaaaaaacagtaaaaaacagatcacgtgtgtacagcagcagtgctgaagctcagggtctcatgacggcagttggacaaatgctggacaagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacagacaaatcagaaatcaacagcccttgaaaagtgtgcggtgcaacaatgagcaatggggcctgcgacatccccaaatcttgcaccccaagaaagctgtatccccagtcagtccccctcagcactggccgaagacatccggtgcctctagccaccatcaccactgtccaaggcactgtcttctttgggaaggtatctgatttggtcagtcacaaattcttttttagccttccctggagaaaaacaagtccccaagaaaaaattcactctatgtagagaaaaaatattttctctcatgttagtacatgcagaacatttaatattccacaatatatatggttttttattcataa

SEQ ID NO: 2300 - DNA, 4226 bp, Homo sapiens; identical to SEQ ID NO: 2299

SEQ ID NO: 2301 - DNA, 4226 bp, Homo sapiens
agttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaagtgtccagtagggcggaggcggaggcccagaggcaggatgaaaaaccacagtctgagagctggtagagagtgccggagaggcctggaggagacttcggacctgctttcacaactgcagagcctcctggggccacaccttgacaaaggtgactttggtcagctctccggtccagaccccccaggtgaggtgggcgaaagagcacctgatggagcctcccagtcctctcatgagcctatggaagatgctgctcccattctctccccgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctctgcctcctccaaaaggcttcactgctcctcccctgcgggactccacactgataactccatctcactgtgactcagtggcatttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctgtcagatggaagctggtagcctgtttttgctcagctctgatggccagaatgtcgtggggatacaagtcacagaaacagccaaggtcaacatttgggaagaaaaagaaaatgttggatcatttacaaatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccatctggggcccgagtgccaaccctttatttcatccacaccccaattccggcccacacctatggctcaggccgaggctcaggcccatcttcaatcttctttcccagtcctatctcctgcttttccatccctgattcagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggatgaatcaccagggacaagtcaggccaagggcaaacccagtccctggcagtcctccatgtccacaggtgaaggcagcaaggaggcacagaaggtgaagttccagctagagagggacccgtgcccacatctggggcaaattctgggtgagaccccacaaaatctatccagggatatgaaaagcttcccacggaaggttctgggggtgacttctgaggagttggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgtgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgaacccttgaagcctcctccagctggacaggagggcaggtggccatctaagcccctcacgtacagcctcacaggcagcatccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcacgaggagcccagaaacccaaactgtcaaggctcatgcaagagccaaaggccaatgtttccccctattcacaagagtgagaagtctaggaaacccaacttagaaaaacatgaagaaaggcttgaaggattgaggactcctcaacttaccccagtcaggaaaacagaagacacccatcaggatgaaggcgtccagctactgccatcaaagaaacagcctccttcagtaagcccctttggagaaaacatcaagcaaatttttcagtggattttttcaaagaaaaaaagcaagccagcaccagtcactgctgagagccaaaaaacagtaaaaaacagatcacgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacagacaaatcagaaatcaacagcccttgaaaagtgtgcggtgcaacaatgagcaatggggcctgcgacatccccaaatcttgcaccccaagaaagctgtatccccagtcagtccccctcagcactggccgaagacatccggtgcctctagccaccatcaccactgtccaaggcactgtcttctttgggaaggtatctgatttggtcagtcacaaattcttttttagccttccctggagaaaaacaagtccccaagaaaaaattcactctatgtagagaaaaaatattttctctcatgttagtacatgcagaacatttaatattccacaatatatatggttttttattcataa

SEQ ID NO: 2302 - DNA, 4209 bp, Homo sapiens
agttgcttgaaagcaacgtgcctattcacatggagaatcttccctttcctttaaaattacttagtgcctcatcgctaaacgcccccagctccacaccatgggtgttggatatcttcctcaccttggtgtttgccctggggttcttcttcctattactcccctacttatcttacttccattgtgatgacccaccctcaccatcgcctgggaagagaaagtgtccagtagggcggaggcggaggcccagaggcaggatgaaaaaccacagtctgagagctggtagagagtgcccgagaggcctggaggagacttcggaccttctttcacaactgcagagcctcctggggccacaccttgacaaaggtgactttggtcagctctccggtccagaccccccaggtgaggtgggcgaaagagcacctgatggagcctcccagtcctctcatgagcctatggaagatgctgctcccattctctccccgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctccgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcctctttcccgccacccaccagagacctgtcagatggaagctggtagcctgtttttgctcagctctgatggccagaatgtcgtggggatacaagtcacagaaacagccaaggtcaacatttgggaagaaaaagaaaatgttggatcatttacaaatcaaatgaccccagaaaagcacttaaattctttggggaatttggctaaatcattggatgctgagcaggacaccacaaacccaaaacccttctggaacatgggagagaactcgaaacagctgcccggacctcagaagtgctcagatcctaggctcttgcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccaccgccaaccctttatttcatccacaccccaattcctgcccacacctatggctcaggccgaggctcaggcccatcttcagtcttctttcccagtcctatctcctgcttttccatccctgattaagaacactggagtagcttgccctgcatcgcagaataaagtgcaagctctctccctacctgaaactcagcaccctgaatggcctttgttgaggaaacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggacgaatcaccagggacaagtcaggccaagggcaaacccagtccctggcagtcctccacgtccacaggtgaaagcagcaaggaggcacagaaggtgaagttccagctagagagggacctgtgcccacatctggggcaaattctgggtgagaccccacaaaatctatccagggacatgaaaagcttcccacggaaggttctgggggtgacttctgaggagtcggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacgcagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgggcccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttagtgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcaagaggagcccagaaacccaaactgtcaaggctcatgcaagagccaaaggccaatgtttccccctattcacaagagtgagaagtctaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagccactttggagaaaacatcaagcaattttttcagtggattttttcaaagaaaaaaagcaagccagcaccagtcactgctgagagccaaaaaacagtaaaaaacagatcatgtgtgtacagcagcagtgctgaagctcagggtctcatgacggcagttggacaaatgctggacaagaaaatgtcactttgccatgcgcaccatgcctcgaaggtaaatcagcacaaacagaagtttcaagccccagtctgtgggtttccctgcaaccacaggcacctcttctactcagaacatggcagaatactgagctatgcagccagcagtcaacaagccactctcaagagccagggttgtcccaacagagacaggcaaatcagaaatcaacagcccttgaaaagtgtgcggtgcaacaatgagcaatggggcctgcgacatccccaaatcttgcaccccaagaaagctgtatccccagtcagtccccctcagcactggccgaagacatccggtgcctctagccaccatcaccactgtccaaggcactgtcttctttgggaaggtatctgatttggtcagtcacaaattcttttttagccttccctggagaaaaacaagtccccaagaaaaaattcactctatgtagagaaaaaatattttctctcatgttagtaaatgcagaacatttaatattccacaatatatatggttttttatt

SEQ ID NO: 2303 - DNA, 4226 bp, Homo sapiens
agttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaagtgtccagtagggcggaggcggaggcccagaggcaggatgaaaaaccacagtctgagagctggtagagagtgcccgagaggcctggaggagacttcggacctgctttcacaactgcagagcctcctggggccacaccttgacaaaggtgactttggtcagctctccggtccagaccccccaggtgaggtgggtgaaagagcacctgatggagcctcccagtcctctcatgagcctatggaagatgctgctcccattctctccccgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctctgcctcctccaaaaggcttcactgctcctcccctgcgggactccacactgataactccatctcactgtgactcagtggcatttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctgtcagatggaagctggtagcctgtttttgctcagctctgatggccagaatgtcgtggggatacaagtcacagaaacagccaaggtcaacatttgggaagaaaaagaaaatgttggatcatttacaaatcgaatgaccccagaaaagcacttaaattatttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccatctggggcccgagtgccaaccctttatttcatccacaccccaattccggcccacacctatggctcaggccgaggctcaggcccatcttcaatcttctttcccagtcctatctcctgcttttccatccctgattcagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggatgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggatatgaaaagcttcccacggaaggttctgggggtgacttctgaggagttggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgtgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgaacccttgaagcctcctccagctggacaggagggcaggtggccatctaagcccctcacgtacagcctcacaggcagcatccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcacgaggagcccagaaacccaaactgtcaaggctcatgcaagagccaaaggccaatgtttccccctattcacaagagtgagaagtctaggaaacccaacttagaaaaacatgaagaaaggcttgaaggattgaggactcctcaacttaccccagtcaggaaaacagaagacacccatcaggatgaaggcgtccagctactgccatcaaagaaacagcctccttcagtaagcccctttggagaaaacatcaagcaaatttttcagtggattttttcaaagaaaaaaagcaagccagcaccagtcactgctgagagccaaaaaacagtaaaaaacagatcacgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacagacaaatcagaaatcaacagcccttgaaaagtgtgcggtgcaacaatgagcaatggggcctgcgacatccccaaatcttgcaccccaagaaagctgtatccccagtcagtccccctcagcactggccgaagacatccggtgcctctagccaccatcaccactgtccaaggcactgtcttctttgggaaggtatctgatttggtcagtcacaaattcttttttagccttccctggagaaaaacaagtccccaagaaaaaattcactctatgtagagaaaaaatattttctctcatgttagtacatgcagaacatttaatattccacaatatatatggttttttattcataa

SEQ ID NO: 2304 - DNA, 4833 bp, Homo sapiens
ggcaccctcagtgctcagttgcttcaggcagctgagctattcagaccatggagaatatcctctgttttctgaacagctatactgagacagggctgagccctgactcacattggttggatatcgaccccaacttcatctgcttgagtgggttggggttgtttatactgtacttgttctacgtggtattgaccctgtattcgtcacccaccgaaaaaaataatgacatccaaaagcatcagggcagagccaagaggagaaggaaaggtgggacattcaaaggtttcccagactggaaaagtttccagagagaagaggaagaggaaaggaagctgctttctcttctgaaaagctttggacctcctgtttcctgcagtcctcggggccagcatcatgataccaaccactttcgtcgactgttatgcccagaccccgtctgtcgggtgtgtaagagagcaactgctgatatccagcaactgctgtcttgggagtccctgaaagatgctgctccctctgtgtcccctttggcttcttcggcttctgcgactgagtcatcgttcactctggcttccaccccctcagcaacccctccagaagacctaatactgtcccctcggcctaaggcctctccaccaccccccttaattctctcacctgacctgatcaccaccttagctgacttattttcaccctcaccactgagggaccctctgccaccacagcctgtttctcccttggattccaagttccccatagaccattccccaccccaacagcttccctttccccttctcccaccacatcacattgagagagtggagtccagcctccaacctgaagccagtttgtctctgaacaccatcttttcatttggctccaccctatgccaagatatttcgcaggccatgaatcccattgattcttgtgctcgtcatcacggaccaccaatcccatctgctttaccaccggaagattgcactgtgactcagtctaaatcaagtctcaccatcttgaagacttttccggaaatgttatctctaggtggctctggtgggtcatccacctctgccccaacaatcaaaggcattgaccattcacaccttgcatcttcagaattcacctggtggcagcctcatgccaaggactctttttcctctaattttgtgccatctgatttcatggaggagcttcttacccttcattcttctgaggcctttttaggggggcactctgtggccaacctcatagagcctgttaacatctcatttctcagccatgacattctggcactcctggagagacaagtcaaaaaaaggggtgatttcctgatgtggaaagaaaatggaaagaaaccaggatcattcccaaaacaacttaggccaaactaccaactaaattcctcacggaatatgttaacctcaattgctgttaagcatgacttggcagaatcctttcctttttgggccagtaaaggcaaactagaatggcagcacatccatcagcagcctccacactctaaatgctttgaagaccatttagagcaaaaatatgtccagctcttctggggtctcccatctttgcacagcgagtctctgcatcctactgttcttgtccaacgtggccattcctccatgtttgtattcttcaatggcattacaaatacatctatatcccatgaatccccagtacttccccctccccaacctctgtccttgcctagtacccaaccactacccttgcctcaaaccctgccccaaggtcagtccccacatctcactcaggtgaagtccctggctcaacctcaatctccattccgagccctactacctagtcctctattcctgattaggatctgtggagtgtgttttcatagaccccagaacgaggcacggtctcttttgccatctgaaattaaccatctggagtggaacgtgttgcagaaagtgcaggaaagtttgtggggcttaccctctgtggttcaaaaatcccaggaagacttttgtcctccagctcccaatcctgaattggtcagaaagtccttcaaggtccatgttccgatctccatcattcctggagattttccactcagctctgaggtaaggaagaaactagagcaacacattcgaaggaggctcatccagcgcagatggggcctgccccgcagaatccatgagtctctgtcattgctacgtcctcagagcaaaatttcagagctatctgtgtcagagagaattcatggaccgttaaatatctctttggttgagggtcagaggtgcaatgttctaaagaagtccgcatcaagcttccctagaagcttccacgagaggagctcaaatatgctttccatggagaatgtggggaattatcagggatacagccaggagactgtcccaaaagatcacctgttgcatggtccggagacttcttcagacaaggatctgaggtctaactctgagagagacctagaaactcatatgatgcatctgtcagggaatgactcaggggtgagactaggtcagaaacaacttgaaaatgccctgacagtacgtttgagcaagaaatttgaggaaatcaatgagggtcgaatgcctgggactgtgcatagttcatggcactcagtcaagcagacaatgtctcttcctgagaaatcccacagccaaattaaacatcgaaatctggtaacattggtgagtgaggaccactgcgttgatacttcccaggaaatttccttccttagttccaacaaacaaaagatgttggaagcccatattaaaactttccgtatgaggatgctgtggggccttcccctcaaggtccttgaatccatagaaatcttcaaatcgaaagcggacctttccacttccttttcccatttcgaccttccctcctcagccaccttcatctctcagggagattccaaagatggggtctctaagtcccgtagtcgaagcacttttcaaggagaaaagttgggaacaacaagctcagtccccatccttgatcgtcctcaccctgtctcctcacctgtcgtccaagaagggcaggggaccctgagaagacaattttctgatactgaccatgaccttatagagacagattccaaagacggggcctccacatcccttagaagaggtactacagattttcaaagcgaaaaattagattcaacaagctcattccccatcctcggtcattcttaccttgtcacttcacctgtcaaccaagaaaagcaggggaccctgagaagagaattctctgatactgacaatgatcttacagaaagtgtccggacaacagaggatggcagacagacttttctgcccccgccacacagcatcgtagacgaagtcagtcagaaacagactgtactggccagtagatgcagcgcagagctgcccataatgcaagctggagctggctgtgagtcatgggataagagaaagagttcctttcataatgtagacaggcttcagggcagtagaaagacctttcctgtcaccaatgctcttcaatcacaaactaggaacaacttgacaaccagcaagtcaggaagctgctcactgacaaatgtgaaagcaagcacttccaatgaaactgaaattttcccaccaagaatatcagttcctcaagatcctaaatcatcataccttaaaaatcagatgttgagccagttaaagttggtccagaggaagcatagccaacctcagagccatttcactgacatgtcttttgccttagataacttgagttccaaggacttactgactaattcccagggcatctcgagtggggacatgggaacttcccaggtggtgcatgtccacttggaggacagcggaatccgtgtggcacagaagcaggagcccagggtccctacctgtgtcttacagaagtgtcaagttacgaatttcccaccagctgtaaacagagtgagtcctgtgagacccaaaggaggagagcttgatggaggggatgcagggctggggacatcccaacgcaggagaaagagcctccctgttcataacaagacatcaggggaggtgcttgggagcaaatcttccccaaccttgaaaacacagcctcctcctgaaaaccttttcagaaaatggatgaagacctctttgcagtggtttaataaacccagcatatcatatgaagaacaagaaagttcctgggaaaagggtagctccctgtcatcatgtgtgcagaatattggtcgagttataagagctgcctttactgggactactgaagctcagaaaattaggaaagacactagggagttcctagaagagaagctggggcataggcatgggatagatatcacctgtccccaagagcccctttccttcccagtggggcttgggaaagctcagcacaacccagaagtgcatgtcagagcagagcctgtccagggctgtccctgcaactacagggctccctcctgcaaagtgacacgtaccaaatcttgcagccaacaagctatctttgttggccagaattatcctacaaggattagacagatcatagacaaggacagacagccccagaaagttgaggcatttaaggggaagatactgtgtcaaagccatccccaatccatgccccacaggaagcctgtgccacatccaaaccccacttgccggcgtcaggtcagcctggtgtgtccagccgtcccaaccagtgctaaaagccctgtgtttagtgatgtgcctttcctaactggacagaaaatgcttccaaagcatttacagggaggaaaatttccccccacaaaataattcactccttgttgagaatcttgattctccccaataaatgttccaataagaagga

SEQ ID NO: 2305 - DNA, 4677 bp, Homo sapiens
gggggagggaaacggagcagtgacaggtatcccagagggtgctgctgaggcgacgatggccgaggggcccgaggaagcccgaggccaccctcccgggcaggacgatggcggaggggaccacgagcccgtcccttccctgagaggccctcctaccaccgccgtcccatgcccccgcgacgacccccaggccgaaccccaggccccgggccggcccacagccccgggcctcgcggctgccgccgcagccgacaaattggagccgccgcgcgagctcaggaagcgcggggaggcggcctccggctccggtgcagagctgcaggagcaggcgggctgcgaggcgcccgaagccgcggcgccacgagagagaccagctcggctgagcgcccgcgagtactcccggcaagtgcacgagtggctgtggcagtcctactgcggctacctcacctggcacagcggcctggccgccttcccagcctactgcagcccccagccctccccgcagagcttcccttcgggcggcgctgcagtcccccaggccgcggcgccgccgcccccgcagctgggctattacaaccccttctacttcctgagccccggggccgcggggcctgacccgcggacagctgccggcatcagcacccctgctccagtcgcgggcctgggaccccgggctcctcacgtgcaggcgtcggtccgggccactccagtgacgagggtaggatccgcagccccttcgcgaagcccgagcgagaccgggcgacaggcaggcagagaatatgttattccatccttggcccacagatttatggcagagatggtggatttctttattctcttctttataaaagcaaccattgtcttaagcattatgcacctcagtgggataaaggatatctctaagtttgctatgcattatataatagaagaaatagatgaagacacatcaatggaagacttgcagaaaatgatggttgtggcacttatatacagattattagtttgtttctatgagataatttgcatttggggagcaggtggagctaccccagggaagttcctgctggggcttcgagttgtgacatgtgatacatcagtgcttattgcaccaagtcgggttttagtgattccttcctcaaatgttagcattacaacgtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgattttataaacaatggacaatatatactttcttaagatctaaggtactttcttaagatctaagaatttgctgaaagcattttcagctttgaaatctccaaatgaaactttaaaatttattttggtttatcccaaaataatggaaaatgtccagttgtgttttgtaaacacctatgtaactcatcttttagtttacacttcctggggaaattgtctttggtgtttagaggagggaatgagaacacaaattggataatccactgtctcccatcccaggaggtggtgagttggctacaagagaaagggacaagtgaggcaggcctagcagttcccttacctgaagttttcaaatccatactgcagttccctctcgtaatgatgtaactttacaactattcttaatgcttgaacatgtatttaggggcaagtttctcatgatgatgaaaaagtatcaagtcatattgctatgttaattggtttttttttttaaaaggtaagttagtgattactgttaatggtgggggagtaagttttcactgtaaattgaacttataatttatgtgcaagtgttttcagtgccctgaatcaaactataaatgtggggagaaatcacctccatcaaacagttgcatatttactgtaaaagtattcccagtatgtgtgcagcatgaagaaagtattagtgcttctcagtgttctcagtgtaaattctatttatatacagcatattcacatactactttccttatattttatatagttctatgactgttgaaacatcaaggagttaaaaaaatcttaatatttcatgattaactctaagtactattaattaatagcttgcgaaatattagcaattttcccattatggactattctctctaaagcaagagagactagcattcccagacatcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgcacagttcaaaatttgattacttaagggatcaatctaggtggtgttcttggtcttaaatttaacagcaaacacagcacatatctattatcactatattaattttcaaaggtttttctttgacgtttaaaactgtgacaacagatattcacatttgattatagaaacttaatgtctattaataattttagtacaaaatttcataaaccgtgtttttcaaaataagtttatgtcaaatccagcttcccagaaacactaataattaagtacatcaatgtactaaataaatcattcagttgcacccatggggaagattgtgttactgcccttcacagtgaaaaaaagaaaaatctttcatttttaaaattaggagatgttacgtaacttggcactttagtagtgtatacactagcattagtttatacaccacttttgccgctggggaattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagccaaaagaaagttgtcttcattgtacaaacatattcatcactttaacaataagggaacaaaatttagtattcaagctgagtgagaatactgtttcaatgagcatgtccctaagataaaccagaattggcagttaatttaggcgtctagaaaatctcagttcccaccagtaaaattatcctgagtagctaatgcaccttgagaaaaatctggcatactgaataaataacattaacttgggagccaagagctgggtaagccttacctttagactactctgtgactacagaaataaagccagcacttttggaactaataagccttcacttgtcagtatcataaagagtattgcccaactgaactttgctcccactggtttaatagttacttatttctgcctaagcactcaccttccgattttacccaagtatatatataggatagaaaaaaatgcattatatttgagagctacttcgcccaaattacaaaatgagtgtttttagattcaagtgacagtaaaaggatttgttcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagttgtttctttgaatatgcctaaataacagtattcttaaaatctgacagacaagtaacatgtcaattacttgatattccttgtctccagtaccacaggccactcttgacatcccatgtttgcctggataaagttcctcatttcaaacagtatacatacttctttgcagttcattatagtaaggcttaacctgtaaacagtatctgatggcccacctataaataaaattcagcattctatttttaataatttgtatgccaccaatttgtattatttgtctcaataaatacttagtcatcaatgca

SEQ ID NO: 2306 - DNA, 1180 bp, Homo sapiens
attgggggagggaaacggagcagtgacaggtatcccagagggtgctgctgaggctcctcacgtgcaggcgtcggtccgggccactccagtgacgagggtaggatccgcagccccttcgcgaagcccgagcgagaccgggcgacaggcaggcagagaatatgttattccatccttggcccacagatttatggcagagatggtggatttctttattctcttctttataaaagcaaccattgtcttaagcattatgcacctcagtgggataaaggatatctctaagtttgctatgcattatataatagaagaaatagatgaagacacatcaatggaagacttgcagaaaatgatggttgtggcacttatatacagattattagtttgtttctatgagataatttgcatttggggagcaggtggagctaccccagggaagttcctgctggggcttcgagttgtgacatgtgatacatcagtgcttattgcaccaagtcgggttttagtgattccttcctcaaatgttagcattacaacgtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgattttataaacaatggacaatatatactttcttaagatctaaggtactttcttaagatctaagaatttgctgaaagcattttcagctttgaaatctccaaatgaaactttaaaatttattttggtttatcccaaaataatggaaaatgtccagttgtgttttgtaaacacctatgtaactcatcttttagtttacacttcctggggaaattgtctttggtgtttagaggagggaatgagaacacaaattggataatccactgtctcccatccca

SEQ ID NO: 2307 - DNA, 1897 bp, Homo sapiens
gtgggcggccccatcgcctagcaaccgggtggcagcgtcccttgagcccaggccacacagctgcacccagccctgcccggctcctcccaggcctgcaggacccctggggccctgtccttattccccagcaccgggacagccaaagctctggtcacaatgaacatcgtcttctccagggacagccaggtgagggtgatggagaataccgtggccaacaccgagaagtactttgggcagttctgctcgctgctggccgcctacacgcgcaagacggcccggctgcgggacaaggcggaccagctggtcaagcagctcatcgactttgccaactccgagaaccccgagctgcgggccaccatgaggggcttcgctgaggacctggccaaagtgcaggattaccggcaggcccaggtcgagaggctggagaccaaggtggtcaaccccctgaagctctacggggcacagatcaagcagacacgggctgagatcaagaaattcaaacatgtccaaaatcatgagatcaaacaactggaaaaactggagaaactgaggcagaagtcaccctcggatcagcaaatgatcggccaggcagagaccagagtgcagagggccgctgtggactccagccgcaccaccctccagctggaggagactgtggatggcttccagaggcagaagctcaaggacctgcagaaatttttttgtgactttgtaactattgagatggttttccatgccaaagcggtggaggtgtattctagcgccttccagaccctggagaagtatgacctggagagggatctactggattttagagccaagatgcaaggagtttatgggcattatgacactcggctgcttgccaacaccagcccccctccatctgttcttcagtctctcgccagccagggaactctgcaggtccagctgagtagggcaaatgaagaccctgaacatcctcatgccaatcatggcaggtttagtctctgtgagtgggtggttaaggggcagccagcccactgtgtgtgtgggcagggtgggcatctcatgcttccaggacattctctctaacgacgtagggtaagtgcaatcccaagccgtttaaaataatcccagactgcctggaggctttgttcttattttctgattcttttttctttgtctttgttggattgtgttaattcaaagaccttgtcttcaagctctgaatttccttcttctacttgttcaattctgttgctgagactttccagagcattttgcatttctgtgagtgtatccaatgtttcctgaagttttgattgtttttctttatgctatctatttcttggtccgagcccactgctcccggcggtgtgaccttgggaaagtctcctagcctctctgtgccttagagtcctcgcctgcagagtggcttagaacagtaacctccgtgtagggctgtgctgagtatcagatgaacagatctatacgaagcacagaaaacccggcctgttgcgcaacaaacacttgagacttgttgctgccattatcattactgatgttgctgtcgttttattattattattatttagagtgctcagagcaccatatggagcccaggaaaagaaggggaggagagtgaggacaactccatggaggaggcccccgtggaggacctcagggcactggggcagggaccccataagagagaactgcccacaacagtcagaagaacttagctggccttggatcctcaggtgggctctgctgtgtgccctcaggcaagccacgtgtcctctgagcctcagtttcctcatctgtacaacagggccaatatcactcacttcacaggttgctctgggggatcgctgtgcctggcatatagtaggtgttcaataaatgccctgtgactctc

SEQ ID NO: 2308 - DNA, 1897 bp, Homo sapiens
gtgggcggccccatcgcctagcaaccgggtggcagcgtcccttgagcccaggccacacagctgcacccagccctgcccggctcctcccaggcctgcaggacccctggggccctgtccttattccccagcaccgggacagccaaagctctggtcacaatgaacatcgtcttctccagggacagccaggtgagggtgatggagaataccgtggccaacaccgagaagtactttgggcagttctgctcgctgctggccgcctacacgcgcaagacggcccggctgcgggacaaggcggaccagctggtcaagcagctcatcgactttgccaactccgagaaccccgagctgcgggccaccatgaggggcttcgctgaggacctggccaaagtgcaggattaccggcaggcccaggtcgagaggctggagaccaaggtggtcaaccccctgaagctctacggggcacagatcaagcagacacgggctgagatcaagaaattcaaacatgtccaaaatcatgagatcaaacaactggaaaaactggagaaactgaggcagaagtcaccctcggatcagcaaatgatctcccaggcagagaccagagtgcagagggccgctgtggactccagccgcaccaccctccagctggaggagactgtggatggcttccagaggcagaagctcaaggacctgcagaaatttttttgtgactttgtaactattgagatggttttccatgccaaagcggtggaggtgtattctagcgccttccagaccctggagaagtatgacctggagagggatctactggattttagagccaagatgcaaggagtttatgggcattatgacactcggctgcttgccaacaccagcccccctccatctgttcttcagtctctcgccagccagggaactctgcaggtccagctgagtagggcaaatgaagaccctgaacatcctcatgccaatcatggcaggtttagtctctgtgagtgggtggttaaggggcagccagcccactgtgtgtgtgggcagggtgggcatctcatgcttccaggacattctctctaacgacgtagggtaagtgcaatcccaagccgtttaaaataatcccagactgcctggaggctttgttcttattttctgattcttttttctttgtctttgttggattgtgttaattcaaagaccttgtcttcaagctctgaatttccttcttctacttgttcaattctgttgctgagactttccagagcattttgcatttctgtgagtgtatccaatgtttcctgaagttttgattgtttttctttatgctatctatttcttggtccgagcccactgctcccggcggtgtgaccttgggaaagtctcctagcctctctgtgccttagagtcctcgcctgcagagtggcttagaacagtaacctccgtgtagggctgtgctgagtatcagatgaacagatctatacgaagcacagaaaacccggcctgttgcgcaacaaacacttgagacttgttgctgccattatcattactgatgttgctgtcgttttattattattattatttagagtgctcagagcaccatatggagcccaggaaaagaaggggaggagagtgaggacaactccatggaggaggcccccgtggaggacctcagggcactggggcagggaccccataagagagaactgcccacaacagtcagaagaacttagctggccttggatcctcaggtgggctctgctgtgtgccctcaggcaagccacgtgtcctctgagcctcagtttcctcatctgtacaacagggccaatatcactcacttcacaggttgctctgggggatcgctgtgcctggcatatagtaggtgttcaataaatgccctgtgactctc

SEQ ID NO: 2309 - DNA, 3862 bp, Homo sapiens
ggctgagggtgccggcagcggctggaagcgggaggccagtcctggccgggctgggcgacccgaatggagccagggccggcgctggtcccagcggccgcacctccgggggcacggcgcgtaacaggaggcttccggggctgagagcgttacaggctgcgctccggggccagataggccgggcgctcagaaggggagtatgagcctgatgtgggcagaatccagatgagctggccagtgctgtgaaggagctgagagcacccccgagagccgtgagatggcaccaaaaaccaagaaaggatgtaaagtgacactacctgagaagcctgttaaactagcttcacataccagagacaccacaggtgtatctcagatgttcccttcttcaaaggcgagaacaaagtccctcctgggtgatgatgtcttcagcaccatggcaggcctggaagaagctgatgctgaggtttcaggtatctcagaggcagacccacaggctctgctccaggccatgaaggacctggacggcatggatgctgatatcttaggtctgaagaaatctaattcagcccctagcaaaaaagctgcaaaggaccctgggaaaggagagctgcccaaccaccccaagcctgcagggggtgccattcccaccaagaagtcacttccgtctcccagcagctctgggcatcagaacaggaggttttcctctgaagacttggaagacccattgagaggacttctctcctatgatgaaggaggaatcaccaagcagccgcctgtgacacagagtaaaacagcttctgacaagagccccagcacagtgagagatcaaggtccctctattcctctaactcctggggacacccccatccgaaaaaaagaagaattgttgtttgatgatggggatgacatcatggccaccttggggtttggagacagccccaaagcagagaagaggcagataggagaccaggaagggcctcgccctgctcgctccacgctggatgagctgctgggtcgaggcatggccaccaaactcctggcccgcccgggcaccggggagcacagggagttcaagctagacaagaagtaccagaggccacaggacagtgaagatatgtggggtgacgaggacttcacctttggagcctatcagcccactgtggtctcctctgagggccggcagtcccgccggcagtctgtcaggttcttcgcagacagtggcgcagaccccaagggagaaccaggctccaaacagagccctccaatggcttccagccccatccagcccaggaagggaggagctgactggttgggcctcaaggacgaggacttggacctgttccctgcctcacccaccagagaggcccatcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcagccaacctctcaccagcacacaagggcttgagcacgcagctgctggagggagttctggaacaactgcacgagaaagaccgtgtgtcaggcctggtgtctcggggtcccctgtgactcagaaccatgccgcctcagcactccctacaggttccccaaagaggggaacagcccctggagacctctcagccactgagcctgccacgtgtttcccgagcacccagaaacccacagagccttccgtgcccgtccagcccctgctcccagagtccctggcccggagcctgctgccgagcacagaataccagaagcagctcctggcagcacaggtgcaacttcagtgcagccccgctgagctccaggccgagctgctgcatagccaggcccggctggcagagctggaggcccaggtgcggaagctggagctagaacgggcccagcatgagctgctgctggggagtctgcagcagcagcaccaggcagacctggagctcatcgagagtgcacacagaagccgcatcaaggtgctagaaacatcgtaccagcaacgggaggagcggctccggagagagaacgaagagctgtcagctcggtatctgtcgcagtgccaggaggccgaacaggcccgtgctgagcttacggcccagcaccagcggcgcttggcggccatagcgcaggagaaggaccaggaaatggagcggctccgggagctgcagcgggcgtccatcctagacatgcgcagagaccacgaggagcagctgcagcggctaaagctgctgaaggaccgagaggtcgatgcggccaccagtgccacctcccacacgcggtccctgaatagcatcatccaccagatggagaagttctccagcagcctgcacgagttgtcctcccgcgtggaggcctcgcacctcaccacctcccaggagcgggagctggggatccggcagcgtgacgagcagctgcgggcactgcaggagcggctgggccagcagcagcgggacatggaggaggagcggagccggcaacaggaggtcatcgggaagatggaggcacggctgaatgagcagagccggctgctggagcaggaacgctggcgggtgactgccgagcagtccaaggcggagtccatgcagcgcgccctagaggagcaaaggaaggtcacggcccagcagatggccatggaaagggcggagctggaacgggccaagagcgccttgctggaggagcagaagtctgtcatgctcaagtgcggggaggagcggcggcgcctggctgccgagtgggcggagttctccgcgcagcaaaagctgagtaaggagcgggccgagcgcgaggccgagcgggcattgcaggtggacacccagcgggagggcaccctcatcagcctggccaaggagcaggctgagctgaagatcagggccagcgagctccgggccgaggagaagcagctggcagcggagagagcagccctggagcaggagcggcaggagctgcggctggagaaggagaggatcaacgccaccgccctgcgtgtcaagctccgcgccgaggaggtggagagcatgagcaaggtggcctccgagaagtacgaggagggggagcgggcattgcgcgaggcccagcaggtgcaggcagagcagcaggcccggttgcaggcggtgcagcaacagcaggagcggctgcggaagcaggagcagcacatgcaccaggagcatctgagtctggcccagcagaggctgcaactggaccgcgcacgacaggacctgccctctagcctcgtgggtctgttccccagggcccagggccctgcagcctccagccagagtgccctcatgcctcctgctcccaccacccgttggtgcagccagccgccaactggcctggaccccagccccttgcacctccatgccaggctggcactgctgaggcacatggcagagcaggaccgtgacttcttggagaatgaacagttcttcctggagaccctgaagaaagggtcctacaatttgacatctcattcagcctgagtgggaccccagccgattccccaacagagggttcggaccccagaactgtcctgttcctccggctgcctccatggaggcagtgcctggggaggattctgagatgcttgaggcctgatgacagctcttccgtggacagggtgcaagtgcatcctttccaaatgtgccagcccggggcagcccctgcct

SEQ ID NO: 2310 - DNA, 2816 bp, Homo sapiens
ggcagcggctggaagcgggaggccagtcctggccgggctgggcgacccgaatggagccagggccggcgctggtcccagcggccgcacctccgggggcacggcgcgtaacaggaggcttccggggctgagagcgttacaggctgcgctccggggccagataggccgggcgctcagaaggggagtatgagcctgatgtgggcagaatccagatgagctggccagtgctgtgaaggagctgagagcacccccgagagccgtgagatggcaccaaaaaccaagaaaggatgtaaagtgacactacctgagaagcctgttaaactagcttcacataccagagacaccacaggtgtatctcagatgttcccttcttcaaaggcgagaacaaagtccctcctgggtgatgatgtcttcagcaccatggcaggcctggaagaagctgatgctgaggtttcaggtatctcagaggcagacccacaggctctgctccaggccatgaaggacctggacggcatggatgctgatatcttaggtctgaagaaatctaattcagcccctagcaaaaaagctgcaaaggaccctgggaaaggagagctgcccaaccaccccaagcctgcagggggtgccattcccaccaagaagtcacttccgtctcccagcagctctgggcatcagaacaggaggttttcctctgaagacttggaagacccattgagaggacttctctcctatgatgaaggaggaatcaccaagcagccgcctgtgacacagagtaaaacagcttctgacaagagccccagcacagtgagagatcaaggtccctctattcctctaactcctggggacacccccatccgaaaaaaagaagaattgttgtttgatgatggggatgacatcatggccaccttggggtttggagacagccccaaagcagagaagaggcagataggagaccaggaagggcctcgccctgctcgctccacgctggatgagctgctgggtcgaggcatggccaccaaactcctggcccgcccgggcaccggggagcacagggagttcaagctagacaagaagtaccagaggccacaggacagtgaagatatgtggggtgacgaggacttcacctttggagcctatcagcccactgtggtctcctctgagggccggcagtcccgccggcagtctgtcagtaggttcttcgcagacagtggcgcagaccccaagggagaaccaggctccaaacagagccctccaatggcttccagccccatccagcccaggaagggaggagctgactggttgggcctcaaggacgaggacttggacctgttccctgcctcacccaccagagaggcccatcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcagccaacctctcaccagcacacaagggcttgagcacgcagctgctggagggagttctggaacaactgcacgagaaagaccgtgtgtcaggcctggtgtctcggggtcccctgtgactcagaaccatgccgcctcagcactccctacaggttccccaaagaggggaacagcccctggagacctctcagccactgagcctgccacgtgtttcccgagcacccagaaacccacagagccttccgtgcccgtccagcccctgctcccagagtccctggcccggagcctgctgccgagcacagaataccagaagcagctcctggcagcacaggtgcaacttcagtgcagccccgctgagctccaggccgagctgctgcatagccaggcccggctggcagagctggaggcccaggtgcggaagctggagctagaacgggcccagcatgagctgctgctggggagtctgcagcagcagcaccaggcagacctggagctcatcgagagtgcacacagaagccgcatcaaggtgctagaaacatcgtaccagcaacgggaggagcggctccggagagagaacgaagagctgtcagctcggtatctgtcgcagtgccaggaggccgaacaggcccgtgctgagcttacggcccagcaccagcggcgcttggcggccatagcgcaggagaaggaccaggaaatggagcggctccgggagctgcagcgggcgtccatcctagacatgcgcagagaccacgaggagcagctgcagcggctaaagctgctgaaggaccgagaggtcgatgcggccaccagtgccacctcccacacgcggtccctgaatagcatcatccaccagatggagaagttctccagcagcctgcacgagttgtcctcccgcgtggaggcctcgcacctcaccacctcccaggagcgggagctggggatccggcagcgtgacgagcagctgcgggcactgcaggagcggctgggccagcagcagcgggacatggggagggacgaggagggaagcctctgtgctgctcacctgcccaaagcccagctcagcgggtacgcagtggaggcgacaaggaaccaatcacaactacagaggtttctctgatcctcctccactcccgctgcttcaacttgactaagcttaaaaaaactgcttttgccatggct

SEQ ID NO: 2311 - DNA, 3865 bp, Homo sapiens
ggctgagggtgccggcagcggctggaagcgggaggccagtcctggccgggctgggcgacccgaatggagccagggccggcgctggtcccagcggccgcacctccgggggcacggcgcgtaacaggaggcttccggggctgagagcgttacaggctgcgctccggggccagataggccgggcgctcagaaggggagtatgagcctgatgtgggcagaatccagatgagctggccagtgctgtgaaggagctgagagcacccccgagagccgtgagatggcaccaaaaaccaagaaaggatgtaaagtgacactacctgagaagcctgttaaactagcttcacataccagagacaccacaggtgtatctcagatgttcccttcttcaaaggcgagaacaaagtccctcctgggtgatgatgtcttcagcaccatggcaggcctggaagaagctgatgctgaggtttcaggtatctcagaggcagacccacaggctctgctccaggccatgaaggacctggacggcatggatgctgatatcttaggtctgaagaaatctaattcagcccctagcaaaaaagctgcaaaggaccctgggaaaggagagctgcccaaccaccccaagcctgcagggggtgccattcccaccaagaagtcacttccgtctcccagcagctctgggcatcagaacaggaggttttcctctgaagacttggaagacccattgagaggacttctctcctatgatgaaggaggaatcaccaagcagccgcctgtgacacagagtaaaacagcttctgacaagagccccagcacagtgagagatcaaggtccctctattcctctaactcctggggacacccccatccgaaaaaaagaagaattgttgtttgatgatggggatgacatcatggccaccttggggtttggagacagccccaaagcagagaagaggcagataggagaccaggaagggcctcgccctgctcgctccacgctggatgagctgctgggtcgaggcatggccaccaaactcctggcccgcccgggcaccggggagcacagggagttcaagctagacaagaagtaccagaggccacaggacagtgaagatatgtggggtgacgaggacttcacctttggagcctatcagcccactgtggtctcctctgagggccggcagtcccgccggcagtctgtcagtaggttcttcgcagacagtggcgcagaccccaagggagaaccaggctccaaacagagccctccaatggcttccagccccatccagcccaggaagggaggagctgactggttgggcctcaaggacgaggacttggacctgttccctgcctcacccaccagagaggcccatcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcagccaacctctcaccagcacacaagggcttgagcacgcagctgctggagggagttctggaacaactgcacgagaaagaccgtgtgtcaggcctggtgtctcggggtcccctgtgactcagaaccatgccgcctcagcactccctacaggttccccaaagaggggaacagcccctggagacctctcagccactgagcctgccacgtgtttcccgagcacccagaaacccacagagccttccgtgcccgtccagcccctgctcccagagtccctggcccggagcctgctgccgagcacagaataccagaagcagctcctggcagcacaggtgcaacttcagtgcagccccgctgagctccaggccgagctgctgcatagccaggcccggctggcagagctggaggcccaggtgcggaagctggagctagaacgggcccagcatgagctgctgctggggagtctgcagcagcagcaccaggcagacctggagctcatcgagagtgcacacagaagccgcatcaaggtgctagaaacatcgtaccagcaacgggaggagcggctccggagagagaacgaagagctgtcagctcggtatctgtcgcagtgccaggaggccgaacaggcccgtgctgagcttacggcccagcaccagcggcgcttggcggccatagcgcaggagaaggaccaggaaatggagcggctccgggagctgcagcgggcgtccatcctagacatgcgcagagaccacgaggagcagctgcagcggctaaagctgctgaaggaccgagaggtcgatgcggccaccagtgccacctcccacacgcggtccctgaatagcatcatccaccagatggagaagttctccagcagcctgcacgagttgtcctcccgcgtggaggcctcgcacctcaccacctcccaggagcgggagctggggatccggcagcgtgacgagcagctgcgggcactgcaggagcggctgggccagcagcagcgggacatggaggaggagcggagccggcaacaggaggtcatcgggaagatggaggcacggctgaatgagcagagccggctgctggagcaggaacgctggcgggtgactgccgagcagtccaaggcggagtccatgcagcgcgccctagaggagcaaaggaaggtcacggcccagcagatggccatggaaagggcggagctggaacgggccaagagcgccttgctggaggagcagaagtctgtcatgctcaagtgcggggaggagcggcggcgcctggctgccgagtgggcggagttctccgcgcagcaaaagctgagtaaggagcgggccgagcgcgaggccgagcgggcattgcaggtggacacccagcgggagggcaccctcatcagcctggccaaggagcaggctgagctgaagatcagggccagcgagctccgggccgaggagaagcagctggcagcggagagagcagccctggagcaggagcggcaggagctgcggctggagaaggagaggatcaacgccaccgccctgcgtgtcaagctccgcgccgaggaggtggagagcatgagcaaggtggcctccgagaagtacgaggagggggagcgggcattgcgcgaggcccagcaggtgcaggcagagcagcaggcccggttgcaggcggtgcagcaacagcaggagcggctgcggaagcaggagcagcacatgcaccaggagcatctgagtctggcccagcagaggctgcaactggaccgcgcacgacaggacctgccctctagcctcgtgggtctgttccccagggcccagggccctgcagcctccagccagagtgccctcatgcctcctgctcccaccacccgttggtgcagccagccgccaactggcctggaccccagccccttgcacctccatgccaggctggcactgctgaggcacatggcagagcaggaccgtgacttcttggagaatgaacagttcttcctggagaccctgaagaaagggtcctacaatttgacatctcattcagcctgagtgggaccccagccgattccccaacagagggttcggaccccagaactgtcctgttcctccggctgcctccatggaggcagtgcctggggaggattctgagatgcttgaggcctgatgacagctcttccgtggacagggtgcaagtgcatcctttccaaatgtgccagcccggggcagcccctgcct

SEQ ID NO: 2312 - DNA, 3444 bp, Homo sapiens
gcaccaaaaaccaagaaaggatgtaaaggctccattgatgattttcttggtgaccttctaggggatgatatgacactacctgagaagcctgttaaactagcttcacataccagagacaccacaggtgtatctcagatgttcccttcttcaaaggcgagaacaaagtccctcctgggtgatgatgtcttcagcaccatggcaggcctggaagaagctgatgctgaggtttcaggtatctcagaggcagacccacaggctctgctccaggccatgaaggacctggacggcatggatgctgatatcttaggtctgaagaaatctaattcagcccctagcaaaaaagctgcaaaggaccctgggaaaggagagctgcccaaccaccccaagcctgcagggggtgccattcccaccaagaagtcacttccgtctcccagcagctctgggcatcagaacaggaggttttcctctgaagacttggaagacccattgagaggacttctctcctatgatgaaggaggaatcaccaagcagccgcctgtgacacagagtaaaacagcttctgacaagagccccagcacagtgagagatcaaggtccctctattcctctaactcctggggacacccccatccgaaaaaaagaagaattgttgtttgatgatggggatgacatcatggccaccttggggtttggagacagccccaaagcagagaagaggcagataggagaccaggaagggcctcgccctgctcgctccacgctggatgagctgctgggtcgaggcatggccaccaaactcctggcccgcccgggcaccggggagcacagggagttcaagctagacaagaagtaccagaggccacaggacagtgaagatatgtggggtgacgaggacttcacctttggagcctatcagcccactgtggtctcctctgagggccggcagtcccgccggcagtctgtcagtaggttcttcgcagacagtggcgcagaccccaagggagaaccaggctccaaacagagccctccaatggcttccagccccatccagcccaggaagggaggagctgactggttgggcctcaaggacgaggacttggacctgttccctgcctcacccaccagagaggcccatcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcagccaacctctcaccagcacacaagggcttgagcacgcagctgctggagggagttctggaacaactgcacgagaaagaccgtgtgtcaggcctggtgtctcggggtcccctgtgactcagaaccatgccgcctcagcactccctacaggttccccaaagaggggaacagcccctggagacctctcagccactgagcctgccacgtgtttcccgagcacccagaaacccacagagccttccgtgcccgtccagcccctgctcccagagtccctggcccggagcctgctgccgagcacagaataccagaagcagctcctggcagcacaggtgcaacttcagtgcagccccgctgagctccaggccgagctgctgcatagccaggcccggctggcagagctggaggcccaggtgcggaagctggagctagaacgggcccagcatgagctgctgctggggagtctgcagcagcagcaccaggcagacctggagctcatcgagagtgcacacagaagccgcatcaaggtgctagaaacatcgtaccagcaacgggaggagcggctccggagagagaacgaagagctgtcagctcggtatctgtcgcagtgccaggaggccgaacaggcccgtgctgagcttacggcccagcaccagcggcgcttggcggccatagcgcaggagaaggaccaggaaatggagcggctccgggagctgcagcgggcgtccatcctagacatgcgcagagaccacgaggagcagctgcagcggctaaagctgctgaaggaccgagaggtcgatgcggccaccagtgccacctcccacacgcggtccctgaatagcatcatccaccagatggagaagttctccagcagcctgcacgagttgtcctcccgcgtggaggcctcgcacctcaccacctcccaggagcgggagctggggatccggcagcgtgacgagcagctgcgggcactgcaggagcggctgggccagcagcagcgggacatggaggaggagcggagccggcaacaggaggtcatcgggaagatggaggcacggctgaatgagcagagccggctgctggagcaggaacgctggcgggtgactgccgagcagtccaaggcggagtccatgcagcgcgccctagaggagcaaaggaaggtcacggcccagcagatggccatggaaagggcggagctggaacgggccaagagcgccttgctggaggagcagaagtctgtcatgctcaagtgcggggaggagcggcggcgcctggctgccgagtgggcggagttctccgcgcagcaaaagctgagtaaggagcgggccgagcgcgaggccgagcgggcattgcaggtggacacccagcgggagggcaccctcatcagcctggccaaggagcaggctgagctgaagatcagggccagcgagctccgggccgaggagaagcagctggcagcggagagagcagccctggagcaggagcggcaggagctgcggctggagaaggagaggatcaacgccaccgccctgcgtgtcaagctccgcgccgaggaggtggagagcatgagcaaggtggcctccgagaagtacgaggagggggagcgggcattgcgcgaggcccagcaggtgcaggcagagcagcaggcccggttgcaggcggtgcagcaacagcaggagcggctgcggaagcaggagcagcacatgcaccaggagcatctgagtctggcccagcagaggctgcaactggaccgcgcacgacaggacctgccctctagcctcgtgggtctgttccccagggcccagggccctgcagcctccagccagagtgccctcatgcctcctgctcccaccacccgttggtgcagccagccgccaactggcctggaccccagccccttgcacctccatgccaggctggcactgctgaggcacatggcagagcaggaccgtgacttcttggagaatgaacagttcttcctggagaccctgaagaaagggtcctacaatttgacatctcattcagcctga

SEQ ID NO: 2313 - DNA, 1850 bp, Homo sapiens
gcattttttcctggtttgggggcaaggtctcatgggaaaggtcatgtctctcgaagaaaggttataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctggcaagtcgggactgtgtggcagcggctatttttcttttcccacccagcacgttttcgggctggggacatagggttcagttgagatacggaggcttccttcgggatattgggttctctgaagtgcggatggactagggcagggctgagaccccattcattcactcatttgtttagctctcctttatgcccggcgcagaagataccccttagggtcccaaggcccttcctgtagttaagttccttccttaaggtcattcagctggggcaaagctggggactcgacacctttctatgctaaccattgagctgcctccactttgagcagctcagtggatgaatatagtatcttgaggatacctttgatttgtgcagggttttcttgtgcaggtttgtgacccaggtcagcttaggtcaggatgctgtactgcttgccacaaaatagcctgtactgtcgcgtcgttttttcttgtgaacagactgtttggcatagccgtagagaggggtctgagacatgaatttagtgatacagcgttgatttgtttgtgtaatgaagctgttcaagtggaaagaactgagttgtagtccctgcttcactagtactagaaggattttttaaacctttttgaacctattttgccttatctgtaaaatggaaataatatcaacctggaagaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgtgttatacgtcacacaacagtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaa

SEQ ID NO: 2314 - DNA, 2967 bp, Homo sapiens
attttttcctggtttgggggcaaggtctcatgggaaaggtcatgtctctcgaagaaaggttataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctgaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgtgttatacgtcacacaacagtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaatttctacaatttaatagttttgaatttattataatggctaaaaagaagctaactgaaatgattcctctgtgtaatcatcctgctagctttgtaaaattgtttgtagcattgggacccattgcaggacctgaagaaaagaaacaacttaaatcaactatgttattgatgtcagaggacctaactggcgagcaagccctggcagtgttgggagcaatgggagatatggaaagcagaaactcatgtctgattaaaagagttacttcagttctgcataaacatttggatggctataaaccattagagttgttgaagataactcaagaattaacttttctgcatttccaaaggaaggagttttttgcgaaacttagagaattactgcttagttatttgaaaaatagtttcataccaactgaggtgtctgttctggtccgtgctatttccctgctcccttctcctcacttggacgaagtggggatatcccgaattgaagccgttttaccacagtgtgacctaaataacctgagtagttttgccacatctgttttaagatggattcagcatgatcacatgtatttggataatatgactgcgaaacaactgaaactacttcaaaaattagatcactatggtcgtcagagactacaacacagcaacagtttggatctgttacggaaggaacttaaatctctcaaaggaaacacgtttcctgagtcacttcttgaagaaatgattgctactttacagcatttcatggatgatattaattacataaatgttggggagattgcatcttttatttctagtactgattacctcagtactttgctactagataggatagcctcagtggctgttcagcagattgaaaagatccatccttttacaatccctgctattattcgtccattcagcgtattgaactatgatccacctcaaagggatgaatttttgggaacttgcgtgcaacatcttaattcttacttaggtatattggatccttttatattagtgtttcttggtttctctttggccacacttgaatattttccagaagatctgctaaaggcaatttttaacatcaaattcttagctagattggattctcaacttgaaattttatctccatctcgaagtgcaagagtccagtttcatcttatggagttaaatagatcagtctgcttggaatgccctgagtttcagattccatggtttcatgaccgcttctgtcaacaatataataaaggtattggtggcatggatggaacacaacagcagatttttaaaatgttagcagaggtactaggaggaatcaattgtgtaaaagcctcggttcttacgccttattaccacaaagtagattttgagtgtatcttggataaaagaaaaaaacctcttccgtatggaagccataatatagcattgggacaactaccagaaatgccctgggaatcaaatatcgaaatagttggatcaaggctgccaccaggggctgaaaggattgctttggaatttttggattcaaaagcactttgtagaaatatccctcacatgaaaggaaaatctgctatgaaaaaacgacatttggaaattctggggtatcgtgtaattcagatttcccagtttgaatggaactctatggcactgtcaacaaaggatgctcggatggactacctgagagaatgtatatttggagaagtcaagtcatgtttgtagtttttatttaaaatgaatgttatcgtgtgttacatttggacctattttaataaagtggcctgtctcaattaaaaaa

SEQ ID NO: 2315 - DNA, 2791 bp, Homo sapiens
atgtctctcgaagaaaggttataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctgaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgtgttatacgtcacacaacagtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaatttctacaatttaatagttttgaatttattataatggctaaaaagaagctaactgaaatgattcctctgtgtaatcatcctgctagctttgtaaaattgtttgtagcattgggacccattgcaggacctgaagaaaagaaacaacttaaatcaactatgttattgatgtcagaggacctaactggcgagcaagccctggcagtgttgggagcaatgggagatatggaaagcagaaactcatgtctgattaaaagagttacttcagttctgcataaacatttggatggctataaaccattagagttgttgaagataactcaagaattaacttttctgcatttccaaaggaaggagttttttgcgaaacttagagaattactgcttagttatttgaaaaatagtttcataccaactgaggtgtctgttctggtccgtgctatttccctgctcccttctcctcacttggacgaagtggggatatcccgaattgaagccgttttaccacagtgtgacctaaataacctgagtagttttgccacatctgttttaagatggattcagcatgatcacatgtatttggataatatgactgcgaaacaactgaaactacttcaaaaattagatcactatggtcgtcagagactacaacacagcaacagtttggatctgttacggaaggaacttaaatctctcaaaggaaacacgtttcctgagtcacttcttgaagaaatgattgctactttacagcatttcatggatgatattaattacataaatgttggggagattgcatcttttatttctagtactgattacctcagtactttgctactagataggatagcctcagtggctgttcagcagattgaaaagatccatccttttacaatccctgctattattcgtccattcagcgtattgaactatgatccacctcaaagggatgaatttttgggaacttgcgtgcaacatcttaattcttacttaggtatattggatccttttatattagtgtttcttggtttctctttggccacacttgaatattttccagaagatctgctaaaggcaatttttaacatcaaattcttagctagattggattctcaacttgaaagtattggtggcatggatggaacacaacagcagatttttaaaatgttagcagaggtactaggaggaatcaattgtgtaaaagcctcggttcttacgccttattaccacaaagtagattttgagtgtatcttggataaaagaaaaaaacctcttccgtatggaagccataatatagcattgggacaactaccagaaatgccctgggaatcaaatatcgaaatagttggatcaaggctgccaccaggggctgaaaggattgctttggaatttttggattcaaaagcactttgtagaaatatccctcacatgaaaggaaaatctgctatgaaaaaacgacatttggaaattctggggtatcgtgtaattcagatttcccagtttgaatggaactctatggcactgtcaacaaaggatgctcggatggactacctgagagaatgtatatttggagaagtcaagtcatgtttgtagtttttatttaaaatgaatgttatcgtgtgttacatttggacctattttaataaagtggcctgtctcaatt

SEQ ID NO: 2316 - DNA, 2402 bp, Homo sapiens
ggagtgattgcccggcagagcgcgatactcgtttgtagtttcataaacattgatgttgggtcaatcatgttctcaatgtatttaaccatgtgtttttaaattttttaatttagttatcaaattgagaatctgatggtatggcattaatcaccttgaggaagaacctttatcgtttatctgattttcagatgcatagagctctggctgctttaaaaaataaacctctaaatcatgttcacaaggtagtcaaggagcgtctgtgcccttggttgtgttcacgacaacctgagcctttcggggtcaaattccatcatgcccattgtaaaaagtttcattcgaaaaatggaaatgaccttcatccactcggtggaccagtgttctctcaagtatctgactgcgacaggcttgaacaaaatgttaaaaatgaggagagtcagatgttttacaggagactgagcaacttgacttcatcagaagaagtgctaagttttataagcacgatggaaaccctgcctgacactatggcagcaggagctttacaacgaatttgtgaagtggaaaaaaaggatggtgatcaagggctgccaaaagaaatactggagaatagcatctttcaagctttatgctttcagtttgaaaaggagccctcacagctgtcaaacactagtttagtgactgctttgcaagctctgattctgttgcatgtggatcctcaaagtagcctgttgctgaacctggtggcagaatgccaaaatcgtctcagaaaaggtggcatggaagttcgcaatctttgtattcttggggaaagtctgattacactgcacagttcaggttgtgtgacactagaactcattataaatcaacttcaaggtgaaaaattggaaacatttaccccggaggatattgtggccctttatagaatcttgcaggcatgtactgaaaaagtggatgaacaccaaacatttttaaataagataaacaacttttccctatcaatagtttccaacctgagtcctaaattgattagccaaatgctcactgccctggtggttcttgatcaaagtcaagcatttcctctgattataaaattgggcaaatatgtcgtgaggcatgtcccacatttcactaacgaggagcttaggagagtcttggaggcgttcatatattttgggcaccatgacacattttttacaaaagccctagagcatcgtgtagctgcggtgtgcctcacgttggatcctgaagttgtctgcagggtcatggagtactgcagtagagaactgattctttcaaaacccatcctcaatgcagtggcagaaacttttgtttgccaaacagaaaaattttcacctcgtcagatttctgccttaatggaaccatttgggaaactcaattatttgccaccaaatgcctctgctttatttagaaagctggaaaacgtgctattcactcatttcaattattttccacccaaatcattattgaaacttcttcattcatgttcacttaatgaatgccatccagtcaactttctggcaaaaatattcaagcctcttttccttcaacggctgcaaggtaaagaatctcatttggacacattgagtcgggcacaactgacccaacttttcttagcctcagtcctggaatgccctttctataagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaatagatgttgaaattaaattagatgaagaaggatttgtattgccatccacagctaatgaagatatccataaaaggatagcactgtgtattgatggtccaaaaaggttttgctccaatagcaaacacttactggggaaagaagctattaaacaaagacacctacagttactcggttatcaagttgttcagatcccctatcatgagattgggatgctaaaatcaagacgtgaattggtggaatatttacaaagaaaactgttttctcaaaacactgttcattggttgcaagaatgaatactgacttcagaactcaaacaatggaagaacttgcatttttatggaactcagtattaaaagaaaaatataatgtgaattagccactttgcagaatatgttctagactggtgatctgaaagcatctgtagttttccttatactatgtatacatttattgtggtaaaatttaaaattaattttaatttaatactagtgtcatagatactttttgtacatcaaacaattgatcatgtgctgtaaaggaattcaatgaataaatgttatttttaagta

SEQ ID NO: 2317 - DNA, 817 bp, Homo sapiens
aggcccacgacgcccaggcgcttccgcgaccacccggagtgattgcccggcagagcgcgttatcaaattgagaatctgatggtatggcattaatcaccttgaggaagaacctttatcgtttatctgattttcagatgcatagagctctggctgctttaaaaaataaacctctaaatcatgttcacaaggtagtcaaggagcgtctgtgcccttggttgtgttcacgacaacctgagcctttcggggtcaaattccatcatgcccattgtaaaaagtttcattcgaaaaatggaaatgaccttcatccactcggtggaccagtgttctctcaagtatctgactgcgacaggcttgaacaaaatgttaaaaatgaggagagtcagatgttttacaggagactgagcaacttgacttcatcagaagaagtgctaagttttataagcacgatggaaaccctgcctgacactatggcagcaggagctttacaacgaatttgtgaagtggaaaaaaaggatggtgatcaagggctgccaaaagaaatactggagaatagcatctttcaagctttatgctttcagtttgaaaaggagccctcacagctgtcaaacactagtttagtgactgctttgcaagctctgattctgttgcatgtggatcctcaaagtagcctgttgctgaacctggtggcagaatgccaaaatcgtctcagaaaaggtggcatggaagttcgcaatctttgtattcttggggaaagtctgattacactgcacagttcaggttgtgtgacactagaactcattataaatcaacttcaagg

SEQ ID NO: 2318 - DNA, 1194 bp, Homo sapiens
ggaactggaacatggtcggagccaaggacacaggactaacaggaaaggacacagactgctgtcaggacacatactaccacacacccgaggccaggaccctgctgacgtggcagacctccaccctggccccttactgccccccgcccctctcccccacctgccagctgccaacagggctctgccttgtgtctgccacacctgtcactgcctatccttgtccagggggggccccatcagcccctcctcagctgcccagcaaagcaagcagttagtggggaggggagggaacatggagcgggggccggtggtgggggcaggactgggggccggggcccgaatccaggcactgctgggctgcctgctcaaggtgctgctctgggtggcctctgccttgctgtactttggaagcgaacaggccgcccgccttctgggcagcccctgcttacggcgcctctaccatgcctggctggcagcagtggtcatctttgggccgcttctgcagttccatgtcaaccctcggactatcttcgccagccacggcaacttcttcaacataaaatttgtgaattcagcctggggctggacatgcactttcttagggggctttgtgttgctggtggtgttcctggctacacggcgcgtggcagtaactgccagacacctgagccgactggtagtaggggcagccgtgtggcggggagccggccgggccttcctgctcatcgaggacctgactggctcctgcttcgagccactgccccagggtctgctgctccacgagctgcctgaccgccgcagctgcctggcagccggccaccagtggcgaggctacaccgtctcctcccacaccttcctgctcaccttttgctgcctgctcatggcagaggaagcagctgtgttcgccaagtacctggcccatgggcttcctgccggcgccccactgcgccttgtcttcctgctgaacgtgctgctgctgggcctctggaacttcttgctgctctgtaccgtcatctatttccaccagtacactcacaaggtggtgggcgccgcagtgggcacctttgcctggtacctcacctatggcagctggtatcatcagccctggtctccagggagcccaggccatgggctcttcccccgtccccactccagccgcaagcataactgaaagaaataaaaaccatcgggcctggc

SEQ ID NO: 2319 - DNA, 4597 bp, Homo sapiens
cggtggctgacgagatccggcatggagcatctggagcgctgcgagtggttgttgcggggaacgctggtgcgggcggccgtgcggcgctacctgccctgggccctggtggcctccatgctggcgggctccctcctcaaggagttgtccccgttgcccgagagctacctcagcaacaagcgcaacgtcctcaacgtgtattttgtcaaagtggcctgggcctggacgttctgtctccttctgcctttcattgccctcaccaactaccatctgaccggcaaggctggcttggtcctgcggcggctgagcaccctgcttgtgggcacggccatctggtacatctgcacctccatcttctccaacatcgaacactacacgggcagctgctaccagtccccagccctggagggggtcagaaaggaacaccagagcaagcagcagtgccaccaggaagggggcttttggcatggctttgacatctcaggtcactccttcctgctgaccttctgcgccctcatgattgtagaagagatgtctgtgctgcatgaggtgaagacggaccgaagccactgcctccacaccgccatcaccaccctggttgtggccctgggcattctgactttcatctgggtgttgatgtttctgtgcacagctgtttatttccacaacttgtcccagaaggtgtttggcaccttgtttggtttgctgagctggtacgggacatacgggttttggtatccgaaagccttttccccaggacttcctccccagagctgtagtttgaatttgaagcaagatagttacaagaaataaaagagtaacagaggggggacagaaggacaatggctaatctatttttcaaatatatattttgcttagttatttggctaaattattgatcctacttcagagggaaagtgtaccaggcagttttggtgggtggtgctgaagtctggggagtgagtttagtcttcagactattcttggcgacatcaccagtgttgcaagcaccaccattcccagttaggcactttttgtccctggtaagacttgacctttatctggaacactccttttgtccctagagtggggacctaaggctcagcaaaagggcagaatcaggaaagcctttatggtgtggctaaaggagtggccagagccttgggactcctttgctgccttctccctggttccagttgtctttagattttcacggctcttactgctgttacttaacagtattttccagccaggcatggtggttcacacctctaatccctgcactttgggaggccgaggcaggcggatcacctgagattgggagttcgagaccagcctgtccaacatggcgaacctcgtctcttctaaaaatacaaaaattagctgggtgtggtggcacatgcctgtaatcccagctactcaggaggctgaggcaggagaattgcttggacctaggaggtggaggttgcagtgagctgagatcgcaccactgcactccagcctgggtgacagagcagactccacctcaaaaaagaaaaaacaaaacaaaacagtatttcccactggtcagttttgcataggcatctatttcaggcagggtttttttcttttttttgagatggagttttgctcttgttgcccaggctggggtgcaatggcccgatctcggctcaccgcaacctccacctcccaggttcaagcgattctcctgcctcagcctcccgagtagctgggattacaggcatgcgtcaccacaccaggctaattttgtatttttagtagagatggggtttctccatgttggtcaggctggtctcaaactcctgaccgcaggtgatccacctgcctcggcctcccaaagtgctgggattacaggcatgagccaccgcgcccggctcaggcagggttctttataaaaacagcctgatgcctgaaggacactctctggttgtaatatttgtttcatccatgaagtgtttaaatattgcaactgacttgcgattagccaccaaaacaggcccttttagatgcagtgcctctccgaccaagtattggatgattcatacgtaatggactatgatcattttctgtccatgttttctattactatatgctggtttttttggagcaataagattactttttttctgttctattttgagcgaatcctttacagtttttgataagaactgtgacatttgttctttgttgataaaactcctgaaaataactcacaaggccagtgctgcactctggcacatgtaggttgttttgagggtttgttggttggttggttggctggttgattggttggttggtttagaacactaatgtacttgttatgaaccaaactctggtcttacagtcttaaattccacctcatggggctgttttctctgttagcaatgaaacctgggccaggtgtagtggctcacacctataatcctggcactttgggaggctgaggtgggaggattactggatcccaggagtttgagaccagcctgggcaacatagtgagaccctggtttctataaataaataagataatcaaaccagaaagcaggcattttagtaacagcctgttgaattttaaggtgaatcaaggtaattttgcagaatgcgttcttgcaccgaaatgtccctgaccacatatcagtggtatagactgaacagtgtgcttcagggtcatgtgctgagtgcactgatcactctgctgtggcccagggcatctgtacctgttggacaagattatgataattcagaagtgaagtaaaatgcctccctctgatggcaaaaagccaacctgtttgcaaaatcacccttattgaagggtggcatggctgtggtccctccctcctgttacttgcatcaccaaccaaactaaaccaaaccatacctgggcctgttcagctggacttgaaatcagtttcctttttctctcccctttgcagcacttttcagtttccagctttgtcattctgtggcctttgctgtgacaatgctgggaagggttagaaatcctgtcacctccatccacaaaggcacagttccacgccctgtgataagatatcccctcttctctcccagactgtctccttaagcctttcaaactgagccccttgctgttggggtaatcacccttaaggccgccttgatgcccctctctccaatcaagtccaatagtagcattaactgagaagcactacacctgactggcttcactgaagcttaagtggttgaggatgaatcttcggtgtaaaatcttttactataaggatatattttaaatatttcatatcccatcaagttggaggttaattttatccatcacaatgagtcatgatttgttgcacccaaaaggagcagaaacacaggtgatgagatatgggaggtggcaccatggtgctttggaggcgttggtaagatgtgaccctctgttgcctatgcccataaaccagtggtgggagtggccatggagtagatggcaggggcttgttgaagggattgaaagctctcctaggctaggcatggtggctcacacctgtaatcctagcactttgggaggctgagatgggaggatcacttgaggttgggccagcctagccaacatgataaaaccccgtctcgactaaaaatacaaaaattagccaggtgtggtggtacacgcctgtaatcccagctactcgggaggctggggcaggagaatcgcttgaacccaggaggcagaggttgcagtgagctaggatcacgccactgcactccagcctgagcgacagagtgagactctgtctcaaaaaaaaaaaaggctctccaaagtgtcatgttcagcaccaaaagggaataggcacagggtgaccccagaagttcatttgtgacacttaaatctccagatatttatcccacgtgggtctgatgcgggctcagcactaaattaactgtatgtggaaagtgtcaattgcagagccttctgtatcgatgaggcttccgccacttgtccatgcttagcccccttgcctcttccttgggagcatgctttctattcctatgtgaaacagcctgacataagtgaaaggatttgggctcaagcaaacatgagatgtgggttcatatcttggcaccactcctgatagctgtgtgatcatggcaaacctcgttttcatcgtctgtcaggtggagatgaagagaaatggtgcatgtaaagtgctcagcatctgtgcttagcaggccatagtctccctgcctcctttttcttgagtaagcctttagaactttctgactcctctagagaaggcagagaaacgaatatattttgggtgccatttggagtctgggtcttttgttaaaattgtcctgtattatgttgaaaagtgtcggttacccccaggctctgggggcatctgtgatcatagaatactgccatgcttattttgcctttctatgttgagattaattcactgacgcctcattttccacgtgcatctgtcatagtctgggtaccagattgtatttagagaatggctcttgccactgttatgtacacacagatcgtgtgtgtaaacaagcaaattaaagtaaactgagataatgaaatcccata

SEQ ID NO: 2320 - DNA, 2044 bp, Homo sapiens
cccacagagtccatggaacccacggagcccatggaacctacggagcccatggaaccggcgcggagcgcgcaccgtgggggcgaggcgctgctgcgggagctggaggtgctggtgcaggacgtggtgaggacgagctcctggtgggagcgccacggcgtggactgcgccatcctcgcgctcagcctcttcgccttgccggcaggcttcctgtgcctgcgctgggagaatgccctggtctttgcatccggcatcaccatcttgggtgtgtgccactacacactcactgtcaagggcagccacctggccactcatggggccctcaccgagtccaaacgctggagcaagatctggctgcttttctttgtggaggtgtgcacagccttcactgcagagcacgccacgcatgggcacgtcaagatgcaccatgcctacaccaacgtggtgggcctgggggactccagcacgtggaggctgccttgcctcaaccgctatgtctacatgttccttgctcctttcctcctccccatcgccactccactggtggctgtcgagcggctgaggaaggtggagctcgggacagccctgcggacgctggccctgatttctctgggcctttattctcactactggctgctcctgaacgtgtcaggcttcaagaaccccagctcagccctgggctgcatgttcctcaccagatccctgttggcccacccctacctccacgtcaacatcttccagcacatcggactgcccatgttctcccgggacaacaagccccgtcggattcacatgatgagcctgggggtgcttaacctggcccggctgcccgtgctggactgggcgttcggccactcgatcatcagctgccatgtggaacaccatctattccccaggctctctgataacatgtgcctgaaggtgaagcccgtggtgtcccagttcctacgtgagaagcagctaccgtacaacgaggactcatacctggctcgcttccagctgtttctccgtcgctatgaggaattcatggtgcaggccccacccatcactgagcttgtggggctgtaatgaggccgggccggtgcagccaccctgcccctccctggcctggccctggccctcctgctgctgctggtccagggggtgtggctcagtggctggtggtggacctggagagtggaggcaccggccaggcaggggggcaggggagctcaggcctggggtctgggggccacctgccttgcgtgcttttctgggttttgaggggtgtctgggggaagcggtaatggtggctgtgcattctggtcagtctggacctcagcaacttcatctcaggactaaagagctgggtccttccccctgctccatctgagccttggtagggttaaagggaggtgacagggtgaagagggatcctgtgcaggggccacctgggagatagcagggggcacagagagagcagggtcagctccctcggctgggacctccctggcattgggagagccccacacggccttggctattgcttccttcaggctctgcccaccaaggtgccctctccccggggaccttagggtgagcttgcttttggcaggccttcctcgatcctcagccaaaggaacctgtgcaagacactggctcagcagttccccaggccacagtatcagcaagataaaagtgagtgtgttttgtcgggagggaactccaggggaagtgaggggagaaggttccccagggacagagttagggaaagagtataaatagccagccaggggcggtggctcatgcctgtaatcccagcactttgggaggccaaggcgggtggatcgcgagatcaggagctcgagaccaccctggccaacatggtgaaaccccgtctctactaaaaatacaaaaaattagctggatgtggtggcatacacttgtagtcccagctacttggcaggctgaggcagaagaatcacctgaacccgggaggtggaggttgcagtgagccaagattgcaccattgcattccagcctgggtgacagagcgagactccatctc

SEQ ID NO: 2321 - DNA, 1095 bp, Homo sapiens
catagatacctgagagttgatggtcaaagcggattagctggggctgtaaggcaggacggccctggacatgcagggtttgaggaggtgggggtgttctccgggctctcaaaggtcctgcattgctcaactgtgcctgacagggaccccagtgtcatttctggttccctcctctaggtgtgcacagccttcactgcagagcacgccacgcatgggcacgtcaagatgcaccatgcctacaccaacgtggtgggcctgggggactccagcacgtggaggctgccttgcctcaaccgctatgtctacatgttccttgctcctttcctcctccccatcgccactccactggtggctgtcgcacatcggactgcccatgttctcccgggacaacaagccccgtcggattcacatgatgagcctgggggtgcttaacctggcccggctgcccgtgctggactgggcgttcggccactcgatcatcagctgccatgtggaacaccatctattccccaggctctctgataacatgtgcctgaaggtgaagcccgtggtgtcccagttcctacgtgagaagcagctaccgtacaacgaggactcatacctggctcgcttccagctgtttctccgtcgctatgaggaattcatggtgcaggccccacccatcactgagcttgtggggctgtaatgaggccgggccggtgcagccaccctgcccctccctggcctggccctggccctcctgctgctgctggtccagggggtgtggctcagtggctggtggtggacctggagagtggaggcaccggccaggcaggggggcaggggagctcaggcctggggtctgggggccacctgccttgcgtgcttttctgggttttgaggggtgtctgggggaagcggtaatggtggctgtgcattctggtcagtctggacctcagcaacttcatctcaggactaaagagctgggtccttccccctgctccatctgagccttggtagggttaaagggaggtgacagggtgaagagggatcctgtgcaggggccacctgggagatagcagggggcacagagagagcagggtcagctccctcggctgg

SEQ ID NO: 2322 - DNA, 5264 bp, Homo sapiens
cactgcccgtccgctcttcagcagccggtcgcgggcggtggaaaagcgagtgaagagagcgcgacggcggcggcggcggcggcgcagctattgctggacggccagtgggagagcgaggcctgagcctctgcgtctaggatcaaaatggtttcaatcccagaatactatgaaggcaagaacgtcctcctcacaggagctaccggttttctagggaaggtgcttctggaaaagttgctgaggtcttgtcctaaggtgaattcagtatatgttttggtgaggcagaaagctggacagacaccacaagagcgagtggaagaagtccttagtggcaagctttttgacagattgagagatgaaaatccagattttagagagaaaattatagcaatcaacagcgaactcacccaacctaaactggctctcagtgaagaagataaagaggtgatcatagattctaccaatattatattccactgtgcagctacagtaaggtttaatgaaaatttaagagatgctgttcagttaaatgtgattgcaacgcgacagcttattctccttgcacaacaaatgaagaatctggaagtgttcatgcatgtatcaacagcatatgcctactgtaatcgcaagcatattgatgaagtagtctatccaccacctgtggatcccaagaagctgattgattctttagagtggatggatgatggcctagtaaatgatatcacgccaaaattgataggagacagacctaatacatacatatacacaaaagcattggcagaatatgttgtacaacaagaaggagcaaaactaaatgtggcaattgtaaggccatcgattgttggtgccagttggaaagaaccttttccaggatggattgataactttaatggaccaagtggtctctttattgcggcagggaaaggaattcttcgaacaatacgtgcctccaacaatgcccttgcagatcttgttcctgtagatgtagttgtcaacatgagtcttgcggcagcctggtattccggagttaatagaccaagaaacatcatggtgtataattgtacaacaggcagcactaatcctttccactggggtgaagttgagtaccatgtaatttccactttcaagaggaatcctctcgaacaggccttcagacggcccaatgtaaatctaacctccaatcatcttttatatcattactggattgctgtaagccataaggccccagcattcctgtatgatatctacctcaggatgactggaagaagcccaaggatgatgaaaacaataactcgtcttcacaaagctatggtgtttcttgaatatttcacaagtaattcttgggtttggaatactgagaatgtcaatatgttaatgaatcaactaaaccctgaagataaaaagaccttcaatattgatgtacggcagttacattgggcagaatatatagagaactactgcttgggaactaagaagtacgtattgaatgaagaaatgtctggcctccctgcagccagaaaacatctgaacaagttgcggaatatacgttatggttttaatactatccttgtgatcctcatctggcgcatttttattgcaagatcacaaatggcaagaaatatctggtactttgtggttagtctgtgttacaagtttttgtcatacttccgagcatccagcactatgagatactgaagaccaaggattcagcattagaacatctatacatatggtgatctaaatgtacaaaatgtaaaatgtataagtcatctcactttttgtcaagacattaaaccatcttagatcggagtgtgaagtaaattatggtatattttatgtaacattttaatgtttatgctcataaaacttagtgaacacactgtgttatgccagctcaaatctacagtagccaccaaaaccatgacttaatattttgagccctagaagaaaggggtgtgctgaggacaagagtggggaaataggaacactgaccagtataactgtgcaattctggaacatattaattaaaataatatgccttaacatatagtgaatttctaattctaatgttcagtgcaatggaagacatttatttggacagtaatactagcaaagttggtagatatttgattcttcattttttgtttttttcattagttgaagtgggttttagttttgtttaaaattataaccagcgtattttcacatcattctgtaagttaaatgatatcaaacatgaaagagatgttctcatttttctttttctgattaaacgtctgatgcatatcatttttctataagtaatcagttgcttttaaaatcagaaggctatattattctaatgaccctattcgatctaaatgggtttgagaatccatatcagcaacatacgtgttttttgacagaaagtgaaaacaaattccgtaaaactgttagtatcaaaaagaataggaatacagttttcttttccacattatgatcaaataaaaatcttgtgagattgtttatgttttgaagcaggaggatttcttgagatttgatggaagtgggagttgggaaggattcaccatacttgtgttctcctccctttataaattttattcataggacttttaaaaggcttgtgctatctttccagtgaaaactgaaagtgcattattatggaagaatgtatttgcaggtagtaatagcattaaaaaatatactcgtgtgtaaacacatactaattttgaccttgaaagatgaattccttcaagaaaaataaaataatgcttaagataatgtgtacgaaattaaataaaggactttatttacatactacataaggtagcaaactgttgaatgagtttgaaggtatcacttattttttatgcatgtgattttagctttagaaagaaatgcgttatagaaacaagtaatagcaagaaaattgatgtatattttaatgatacattaaaattcccttttaatcataatagttaactctacttactgttttaacatacatttgatttaacaaattgttcagcataacacttctaattaagtttatcaagttgtactgtattagataatcagcagtgtatctggagtatgtttaaagagaacagttcgcaatacaaaaagttacatggagctttacatcttaactttctttgtcaatttaaatgcaatgtataaaaagtttattttgctattgtgaaaaactaaatgtaaaggaaatcacctactttcatgcaggtgtataatcttgaaaaggaaaaatgcttccatgttgaagccagattttctgtagtaaaacttttaaatattattttaaaagaaatatgtatataaatatctctatattctttggaatgatactaaagtctctggtctaggaccataccttatataaaggtataagagaccatgacaatgtctgaaaatggaatagataatgatgccttttatttaaagtggcccacataatatacattgagtactccatctctccaaatgtatttccataatgtgttgaaaacatgctaacatttgtatgatttttatacttctgccgaatagacttagaatcagatgaattgtctgtgtgtcttgcaaaagagttggggacaacttgggcaggcctatgaagtgcatagggagtgtatgtcttctgaatggttttattgttcttgtaatctagcttaaagaaatgttaactgggagggtgctgaggccactcactgcattaattttgtgtgtttagagttctgttgtcaaaagaaaactaatgaataaattagtttgtcattctagaatttaaagttctaagattagtataaagagtatatagattgttaatccccaccagctagactttgaacttaagtcagacttaaagatttgagaaattatttgtgtcatttactagacgtgatttttagttctgtttgattatatttcctacacaaacttcttatttaacaggatagcctactaaattaaatgtttcttatttcacttaactcatttgattaaactgtattctaaaacatttggggtttttccccctattcagttttaatcttggaatatgcatttgtaaattgtgatgtcattgagactatatttatatttgacttggcaacattaacatgtcctaagacttagtgcagagaagcttggcagtacgttctttgacttaaggatggcataaaataatcatttttgaacctgtgtaataaagcttgaaagcagggaaaagaatttccttttcccccttttttgtgttgtctataggaattaacttgggattgttttgtgggtttttgtttgttttaaatgtaaattgagaatcttttataagaaataaaagcattattgggtgcctttgtttgtaaaccaaaaagtaataaatgaatccctatatttccattatagtatttattgtatttttatgttctgaaaattacccatggaacaatatgcttaggattacaggaagcagtccttacttacacttcttgtctgttttaggtgtacttgttaattcttatgtcctaattttatttaattctgagttccttacacagcattttagggaaagaatacaggcaggatgacactttgtgttaaagtgttatttttatgtattacctggaatgaggcaggtttttttctgttttctaaaaagagtaaccaagatacctccagggtgtcattgggttccagctgctctcctccacattgaatgatatcttgttaatttataggcacatttgtggtaatttatatgtctatagagtaagtataagagataattcattagtaataggaattaactgaccccttttggatgggggagagcatcaggctggggtcaggtaagtgtaaatggccttctgagcatgctcttctaggctgactcccagccctgacttgaaaccattagcgctaacttgctctgttttgagaaaaactttccaaacttttgcatgagaaactagaaaaaggaatgtatgccacgtaactggattacagaaatgagttaattgtctctgtgataaaaaaaaaaaatgaaatattttcttattgaattaatatttttgtcttgaagcattttctagtgatagaatgtatttgtcttttttcctggtggtaccctcttagcatatatctttgctatccttaagatcctaaacaaatcatctttgtcagttaagtatagttgcgcaaaaattgttaaatcctttgtctttattaaagaaaaatttgagtaacattaa

SEQ ID NO: 2323 - DNA, 1123 bp, Homo sapiens
gagtgaagagagcgcgacggcggcggcggcggcggcgcagctattgctggacggccagtgggagagcgaggcctgagcctctgcgtctaggatcaaaatggtttcaatcccagaatactatgaaggcaagaacgtcctcctcacaggagctaccggttttctagggaaggtgcttctggaaaagttgctgaggtcttgtcctaaggtgaattcagtatatgttttggtgaggcagaaagctggacagacaccacaagagcgagtggaagaagtccttagtggcaagctttttgacagattgagagatgaaaatccagattttagagagaaaattatagcaatcaacagcgaactcacccaacctaaactggctctcagtgaagaagataaagaggtgatcatagattctaccaatattatattccactgtgcagctacagtaaggtttaatgaaaatttaagagatgctgttcagttaaatgtgattgcaacgcgacagcttattctccttgcacaacaaatgaagaatctggaagtgttcatgcatgtatcaacagcatatgcctactgtaatcgcaagcatattgatgaagtagtctatccaccacctgtggatcccaagaagctgattgattctttagagtggatggatgatggcctagtaaatgatatcacgccaaaattgataggagacagacctaatacatacatatacacaaaagcattggcagaatatgttgtacaacaagaaggagcaaaactaaatgtggcaattgtaaggccatcgattgttggtgccagttggaaagaaccttttccaggatggattgataactttaatggaccaagtggtctctttattgcggcagggaaaggaattcttcgaacaatacgtgcctccaacaatgcccttgcagatcttgttcctgtagatgtagttgtcaacatgagtcttgcggcagcctggtattccggagttaatagaccaagaaacatcatggtgtataattgtacaacaggcagcactaatcctttccactggggtgaagttggtatgattttacctgtgtttttgaatgttagaataaatcttaaagaaccaagaaaaaaaaaaaaaaaaaaa

SEQ ID NO: 2324 - DNA, 2095 bp, Homo sapiens
cacagagcctttcaattcagcttggggtgagctgcacttcaggcatggggatataatagtgtgatgaaccattcttctgaaggttcttctgaaaagctgctggtcttgggatactgtgagagcccctctcattgctctttagaagtaatttaaatttttctgctacattgtctgctcagctcgtattctggtcatagaggaacctgaagccagagaaactagacaaaaaggaacctctttcaggagctataaaagaaagggaggaatcatgtccacaattgcagctttctatggcggcaagtccattctcatcacgggggccacaggctttctgggcaaagtgctgatggagaagctgtttcgcaccagcccagacctgaaagtcatttacatccttgtgaggcccaaggctggccagacactgcagcagagggttttccagatcctagacagtaagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggatgacaaagctcatgaatcggcttttaagaactgtttccatgttggagtatttcatcaaccggagttgggaatggagcacgtacaatacagaaatgctgatgtctgagctgagtcctgaagaccagagagtattcaactttgacgtgcgccagttgaactggttggaatacattgaaaattatgttttgggagttaaaaaatacttattgaaagaggatatggctgggatcccaaaagcaaagcaacgcttaaaaaggctccgaaatattcactacctctttaatactgccctcttccttatcgcctggcgccttctcattgcaagatctcagatggctcggaatgtctggttcttcattgtaagcttctgttataaattcctctcctactttagagcatccagcacgctcaaagtttaagagcatttagccatcgctttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcccttgcgtattaaacgtgaaagtactccca

SEQ ID NO: 2325 - DNA, 2073 bp, Homo sapiens
ggcagcggcggagccggggaaggtcggagggagggtggtttcctcccgccccacacccagtctccgagccggatatatagagtgtcacgtttgggagccgaaagactggagccgtttccttgtggctggagcgcttcccgtagcctcggggaaggagcaggatttagaggaccactagttggaccccatcctcgtgctggaggaacaggaacctctttcaggagctataaaagaaagggaggaatcatgtccacaattgcagctttctatggcggcaagtccattctcatcacgggggccacaggctttctgggcaaagtgctgatggagaagctgtttcgcaccagcccagacctgaaagtcatttacatccttgtgaggcccaaggctggccagacactgcagcagagggttttccagatcctagacagtaagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggatgacaaagctcatgaatcggcttttaagaactgtttccatgttggagtatttcatcaaccggagttgggaatggagcacgtacaatacagaaatgctgatgtctgagctgagtcctgaagaccagagagtattcaactttgacgtgcgccagttgaactggttggaatacattgaaaattatgttttgggagttaaaaaatacttattgaaagaggatatggctgggatcccaaaagcaaagcaacgcttaaaaaggctccgaaatattcactacctctttaatactgccctcttccttatcgcctggcgccttctcattgcaagatctcagatggctcggaatgtctggttcttcattgtaagcttctgttataaattcctctcctactttagagcatccagcacgctcaaagtttaagagcatttagccatcgctttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcccttgcgtattaaacgtgaaagtactccca

SEQ ID NO: 2326 - DNA, 1673 bp, Homo sapiens
agagtctccagttggtgaccaagagtacatctcttttcaaatagctggattaggtcctcatgctgctgtggtcattgctggtcatctttgaaagagtaagagagaacttagattcgctgacccttgtggcgccctcttctgtcttcgaaggagacagcatcgttctgaaatgccagggagaacagaactggaaaattcagaagatggcttaccataaggataacaaagagttatctgttttcaaaaaattctcagatttccttatccaaagtgcagttttaagtgacagtggtaactatttctgtagtaccaaaggacaactctttctctgggataaaacttcaaatatagtaaagataaaagtccaaggacctgatggctatagaagagacctcatgacagctggagttctctggggactgtttggtgtccttggtttcactggtgttgctttgctgttgtatgccttgttccacaagatatcaggagaaagttctgccactaatgaacccagaggggcttccaggccaaatcctcaagagttcacctattcaagcccaaccccagacatggaggagctgcagccagtgtatgtcaatgcaaacatcaggacacttctggagaacaaggactcccaagtcatctactcttctgtgaagaaatcataacacttggaggaatcagaagggaagatcaacagcaaggatggggcatcattaagacttgctataaaaccttatgaaaatgcttgaggcttatcacctgccacagccagaacgtgcctcaggaggcacctcctgtcatttttgtcctgatgatgtttcttctccaatatcttcttttacctatcaatattcattgaactgctgctacatccagacactgtgcaaataaattatttctgctaccttctcttaagcaatcagtgtgtaaagatttgagggaagaatgaataagagatacaaggtctcaccttcatctactgtgaagtgatgagaacaggacttgatagtggtgtattaacttatttatgtgctgctggatacagtttgctaatattttgttgagaatttttgcaaatatgttcattgggaatattggcctgaaattttcttttccactgtgtctctgccagaatgtttgtatcaggctgatgctggcttcatagaatgagttaggcaggagcccttcctccttgattttttggcatagtttcagcaggattggtaccagttattctttctgcatcttgtagaattcagctatgaatccatctggtctagggcttttgtgttggttggtaagttttttattactaattcaacttcagcgcttgatattggtctaggaggggtttctgtctcttcctggttcaatcttgggagattgtgtgtttccaggaatttagccgtttcctccagattttcttctttatgtgcatcgacttgagtgtaaacataacttatatgcactgggaaaccaaaaaatctgtgtgacttgctttattgcagcatttgttttattttggtagtctggaactgaacctgcaatatcaccaaagtatgcatatagttgcaaaaatgtgatttttgacatagtaaatatgagtatttgcaataaactatgatattacttttgtaagtatatagaataaaatgtaaataatctataga

SEQ ID NO: 2327 - DNA, 2579 bp, Homo sapiens
gttggtgaccaagagtacatctcttttcaaatagctggattaggtcctcatgctgctgtggtcattgctggtcatctttgatgcagtcactgaacaggcagattcgctgacccttgtggcgccctcttctgtcttcgaaggagacagcatcgttctgaaatgccagggagaacagaactggaaaattcagaagatggcttaccataaggataacaaagagttatctgttttcaaaaaattctcagatttccttatccaaagtgcagttttaagtgacagtggtaactatttctgtagtaccaaaggacaactctttctctgggataaaacttcaaatatagtaaagataaaagtccaagagctctttcaacgtcctgtgctgactgccagctccttccagcccatcgaagggggtccagtgagcctgaaatgtgagacccggctctctccacagaggttggatgttcaactccagttctgcttcttcagagaaaaccaggtcctggggtcaggctggagcagctctccggagctccagatttctgccgtgtggagtgaagacacagggtcttactggtgcaaggcagaaacggtgactcacaggatcagaaaacagagcctccaatcccagattcacgtgcagagaatccccatctctaatgtaagcttggagatccgggcccccgggggacaggtgactgaaggacaaaaactgatcctgctctgctcagtggctgggggtacaggaaatgtcacattctcctggtacagagaggccacaggaaccagtatgggaaagaaaacccagcgttccctgtcagcagagctggagatcccagctgtgaaagagagtgatgccggcaaatattactgtagagctgacaacggccatgtgcctatccagagcaaggtggtgaatatccctgtgagaattccagtgtctcgccctgtcctcaccctcaggtctcctggggcccaggctgcagtgggggacctgctggagcttcactgtgaggccctgagaggctctcccccaatcttgtaccaattttatcatgaggatgtcacccttgggaacagctcggccccctctggaggaggggcctccttcaacctctctttgactgcagaacattctggaaactactcctgtgaggccaacaacggcctgggggcccagtgcagtgaggcagtgccagtctccatctcaggacctgatggctatagaagagacctcatgacagctggagttctctggggactgtttggtgtccttggtttcactggtgttgctttgctgttgtatgccttgttccacaagatatcaggagaaagttctgccactaatgaacccagaggggcttccaggccaaatcctcaagagttcacctattcaagcccaaccccagacatggaggagctgcagccagtgtatgtcaatgtgggctctgtagatgtggatgtggtttattctcaggtctggagcatgcagcagccagaaagctcagcaaacatcaggacacttctggagaacaaggactcccaagtcatctactcttctgtgaagaaatcataacacttggaggaatcagaagggaagatcaacagcaaggatggggcatcattaagacttgctataaaaccttatgaaaatgcttgaggcttatcacctgccacagccagaacgtgcctcaggaggcacctcctgtcatttttgtcctgatgatgtttcttctccaatatcttcttttacctatcaatattcattgaactgctgctacatccagacactgtgcaaataaattatttctgctaccttctcttaagcaatcagtgtgtaaagatttgagggaagaatgaataagagatacaaggtctcaccttcatctactgtgaagtgatgagaacaggacttgatagtggtgtattaacttatttatgtgctgctggatacagtttgctaatattttgttgagaatttttgcaaatatgttcattgggaatattggcctgaaattttcttttccactgtgtctctgccagaatgtttgtatcaggctgatgctggcttcatagaatgagttaggcaggagcccttcctccttgattttttggcatagtttcagcaggattggtaccagttattctttctgcatcttgtagaattcagctatgaatccatctggtctagggcttttgtgttggttggtaagttttttattactaattcaacttcagcgcttgatattggtctaggaggggtttctgtctcttcctggttcaatcttgggagattgtgtgtttccaggaatttagccgtttcctccagattttcttctttatgtgcatcgacttgagtgtaaacataacttatatgcactgggaaaccaaaaaatctgtgtgacttgctttattgcagcatttgttttattttggtagtctggaactgaacctgcaatatcaccaaagtatgcatatagttgcaaaaatgtgatttttgacatagtaaatatgagtatttgcaataaactatgatattacttttgtaagtatatagaataaaatgtaaataatctata

SEQ ID NO: 2328 - DNA, 1669 bp, Homo sapiens
agagtctccagttggtgaccaagagtacatctcttttcaaatagctggattaggtcctcatgctgctgtggtcattgctggtcatctttgatgcagtcactgaacaggcagattcgctgacccttgtggcgccctcttctgtcttcgaaggagacagcatcgttctgaaatgccagggagaacagaactggaaaattcagaagatggcttaccataaggataacaaagagttatctgttttcaaaaaattctcagatttccttatccaaagtgcagttttaagtgacagtggtaactatttctgtagtaccaaaggacaactctttctctgggataaaacttcaaatatagtaaagataaaagtccaaggacctgatggctatagaagagacctcatgacagctggagttctctggggactgtttggtgtccttggtttcactggtgttgctttgctgttgtatgccttgttccacaagatatcaggagaaagttctgccactaatgaacccagaggggcttccaggccaaatcctcaagagttcacctattcaagcccaaccccagacatggaggagctgcagccagtgtatgtcaatgcaaacatcaggacacttctggagaacaaggactcccaagtcatctactcttctgtgaagaaatcataacacttggaggaatcagaagggaagatcaacagcaaggatggggcatcattaagacttgctataaaaccttatgaaaatgcttgaggcttatcacctgccacagccagaacgtgcctcaggaggcacctcctgtcatttttgtcctgatgatgtttcttctccaatatcttcttttacctatcaatattcattgaactgctgctacatccagacactgtgcaaataaattatttctgctaccttctcttaagcaatcagtgtgtaaagatttgagggaagaatgaataagagatacaaggtctcaccttcatctactgtgaagtgatgagaacaggacttgatagtggtgtattaacttatttatgtgctgctggatacagtttgctaatattttgttgagaatttttgcaaatatgttcattgggaatattggcctgaaattttcttttccactgtgtctctgccagaatgtttgtatcaggctgatgctggcttcatagaatgagttaggcaggagcccttcctccttgattttttggcatagtttcagcaggattggtaccagttattctttctgcatcttgtagaattcagctatgaatccatctggtctagggcttttgtgttggttggtaagttttttattactaattcaacttcagcgcttgatattggtctaggaggggtttctgtctcttcctggttcaatcttgggagattgtgtgtttccaggaatttagccgtttcctccagattttcttctttatgtgcatcgacttgagtgtaaacataacttatatgcactgggaaaccaaaaaatctgtgtgacttgctttattgcagcatttgttttattttggtagtctggaactgaacctgcaatatcaccaaagtatgcatatagttgcaaaaatgtgatttttgacatagtaaatatgagtatttgcaataaactatgatattacttttgtaagtatatagaataaaatgtaaataatcta

SEQ ID NO: 2329 - DNA, 1407 bp, Homo sapiens
ggtgaccaagagtacatctcttttcaaatagctggattaggtcctcatgctgctgtggtcattgctggtcatctttgatgcagtcactgaacaggcagattcgctgacccttgtggcgccctcttctgtcttcgaaggagacagcatcgttctgaaatgccagggagaacagaactggaaaattcagaagatggcttaccataaggataacaaagagttatctgttttcaaaaaattctcagatttccttatccaaagtgcagttttaagtgacagtggtaactatttctgtagtaccaaaggacaactctttctctgggataaaacttcaaatatagtaaagataaaagtccaagagctctttcaacgtcctgtgctgactgccagctccttccagcccatcgaagggggtccagtgagcctgaaatgtgagacccggctctctccacagaggttggatgttcaactccagttctgcttcttcagagaaaaccaggtcctggggtcaggctggagcagctctccggagctccagatttctgccgtgtggagtgaagacacagggtcttactggtgcaaggcagaaacggtgactcacaggatcagaaaacagagcctccaatcccagattcacgtgcagagaatccccatctctaatgtaagcttggagatccgggcccccgggggacaggtgactgaaggacaaaaactgatcctgctctgctcagtggctgggggtacaggaaatgtcacattctcctggtacagagaggccacaggaaccagtatgggaaagaaaacccagcgttccctgtcagcagagctggagatcccagctgtgaaagagagtgatgccggcaaatattactgtagagctgacaacggccatgtgcctatccagagcaaggtggtgaatatccctgtgagaattccagtgtctcgccctgtcctcaccctcaggtctcctggggcccaggctgcagtgggggacctgctggagcttcactgtgaggccctgagaggctctcccccaatcttgtaccaattttatcatgaggatgtcacccttgggaacagctcggccccctctggaggaggggcctccttcaacctctctttgactgcagaacattctggaaactactcctgtgaggccaacaacggcctgggggcccagtgcagtgaggcagtgccagtctccatctcaggacctgatggctatagaagagacctcatgacagctggagttctctggggactgtttggtgtccttggtttcactggtgttgctttgctgttgtatgccttgttccacaagatatcaggagaaagttctgccactaatgaacccaggactcccaagtcatctactcttctgtgaagaaatcataacacttggaggaatca

SEQ ID NO: 2330 - DNA, 902 bp, Homo sapiens
gaagagggctggatgggcacaggaaaacaatcagatgagaacaacagatgaccgtgtctgcaggcagcacccagaactgatattcccctcaaacgtctaaatatattgttgagaaaattatctctaactgttctagtgggaatgtgggaatggaaaatatgcaacagccatggggccaggccctttgctgagcctgcaggttgggagtttgtgaatctattgaggcatcacaaatcttttctgatagcccctctgtgtctgtcagttccagtgtctcgccctgtcctcaccctcaggtctcctggggcccaggctgcagtgggggacctgctggagcttcactgtgaggccctgagaggctctcccccaatcttgtaccaattttatcatgaggatgtcacccttgggaacagctcggccccctctggaggaggggcctccttcaacctctctttgactgcagaacattctggaaactactcctgtgaggccaacaacggcctgggggcccagtgcagtgaggcagtgccagtctccatctcaggacctgatggctatagaagagacctcatgacagctggagttctctggggactgtttggtgtccttggtttcactggtgttgctttgctgttgtatgccttgttccacaagatatcaggttgtatctaccatttggattctccatattttgctatgacctttccactactgatatagattgaaattacaaaaaaagaagagagaaaagaaaactctccaaaagccaataatttctttttatgcttcataattctgcaaggctctgtgcaatgctcaatgtggtcatactgctaattatacaatatgtcactgttccctgtgcatagtcactggagattaaattatttacacattctttc

SEQ ID NO: 2331 - DNA, 2582 bp, Homo sapiens
ataacaacttatgtgaaagtcaaaaaggcatatgcttgacaccttgactgtgtgattcacaccacgctcattaagcttgcctacattaggagctgcatgcagaaccaaaggctgtgtgaagacaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagctgtttctacatcctgtgctgagagccagctcttccacgcccatagaggggagtcccatgaccctgacctgtgagacccagctctctccacagaggccagatgtccagctgcaattctccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattggaaaaag

SEQ ID NO: 2332 - DNA, 4725 bp, Homo sapiens
agtgaaggggtttcccatatgaaaaatacagaaagaattatttgaatactagcaaatacacaacttgatatttctagagaacccaggcacagtcttggagacattactcctgagagactgcagctgatggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagctgtttctacatcctgtgctgagagccagctcttccacgcccatagaggggagtcccatgaccctgacctgtgagacccagctctctccacagaggccagatgtccagctgcaattctccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaagacacacccagacgactctgcaggggaggctagcagcagaggcagggcccatgaagaagatgatgaagaaaactatgagaatgtaccacgtgtattactggcctcagaccactagccccttacccagagtggcccacaggaaacagcctgcaccatttttttttctgttctctccaaccacacatcatccatctctccagactctgcctcctacgaggctgggctgcagggtatgtgaggctgagcaaaaggtctgcaaatctcccctgtgcctgatctgtgtgttccccaggaagagagcaggcagcctctgagcaagcactgtgttattttcacagtggagacacgtggcaaggcaggagggccctcagctcctagggctgtcgaatagaggaggagagagaaatggtctagccagggttacaagggcacaatcatgaccatttgatccaagtgtgatcgaaagctgttaatgtgctctctgtataaacaatttgctccaaatattttgtttcccttttttgtgtggctggtagtggcattgctgatgttttggtgtatatgctgtatccttgctaccatattgggaacagccaaaagaagttatagaacaagaatttaaggtgactctatctgaagtgtatttttgtacttacagggtgacattcccaaccaaattaccctagttatgatgaaaaataacttcagcatttcattaaagactctgctagtttaatatgtgacttgtatccccactgcaaagaccttatgtgtgaagaatcacattaattgtaatttttgcttcatgacatagtctcatcatttgccatacatgatagatttctagtcagtcagttttattcttataagcacccattaaccccgagacaataacctactatatctatgtggcttctcccattctcttcctctacctcactccatctgataaaaaaccattctaaatctcatgttcattattcccatgctctcctatttctatcatattaatgtatctacatgttttccttaaatatgtttttatattagttttaactataagttaaagaccatattgttgtagataattttttttagtactttctcttcatgttgtatttctaagattcatccatattgttgcgtgttgctatagttcatttgtttttattgctgtttagtatttacttgtgtaaaatatctggcttaatgttttcctagctatcaccatcaaaaactctttccacagtgtgttgaatttttaatatgacaaaaatgaaaatgtaccaacaattttcagtgacttcacctccattctgaaatcctgatgtttccaaatatctctgaacacctcaagtcctagggacaactgagattatattaacattaatctctgaatgttgccaattctaggccttcacttggttcatgtaggaacaccaagtccctttcaaagcaccacatcttcctctaatcaatatttcttggagtccctagggaatgtcttacatgcattcaaacaatcaccatttctggagatacactacagggtcaccataaactctgctacccttaggttccatcactatggaagctgagtttcaccagaaggcacttttgtcctccattacgaccagcaaagccagctaagccacagctgctggcctcaaaaaatgtgatgatcaatccacactgctcccactggcctctgttacccttatcctggcctttgagtgcagggcatgatgtcctgcccgtactgagatgctgatctctgccagttcatgttcatattggcattaaaattttaaggtcccttgaagagggaggaggcaaatgtctctgtcttctatgtgatacattctgctgtttttttctctatggtgaaaatatgtaaaccggttttgggtaccaaccaccaggctgtatatggaggctctcctcctttctaaccctgctgctgatttggaattaccttgccaagcccctttgtgccttatagtgaactttctctaagggacctgtcatctcttatcattgtttatccattttctagattctgaacccaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattggaaaaagt

SEQ ID NO: 2333 - DNA, 2633 bp, Homo sapiens
gcagctgatggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagctgtttctacatcctgtgctgagagccagctcttccacgcccatagaggggagtcccatgaccctgacctgtgagacccagctctctccacagaggccagatgtccagctgcaattctccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaagacacacccagacgactctgcaggggaggctagcagcagaggcagggcccatgaagaagatgatgaagaaaactatgagaatattctgaacccaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattggaaaaagta

SEQ ID NO: 2334 - DNA, 2786 bp, Homo sapiens
agactgcagctgatggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagctgtttctacatcctgtgctgagagccagctcttccacgcccatagaggggagtcccatgaccctgacctgtgagacccagctctctccacagaggccagatgtccagctgcaattctccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaagacacacccagacgactctgcaggggaggctagcagcagaggcagggcccatgaagaagatgatgaagaaaactatgagaatgtaccacgtgtattactggcctcagaccactagccccttacccagagtggcccacaggaaacagcctgcaccatttttttttctgttctctccaaccacacatcatccatctctccagactctgcctcctacgaggctgggctgcaggattctgaacccaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattggaaaaagta

SEQ ID NO: 2335 - DNA, 3459 bp, Homo sapiens
ctcaatcagctttatgcagagaagaagcttactgagctcactgctggtgctggtgtaggcaagtgctgctttggcaatctgggctgacctggcttgtctcctcagaactccttctccaatcctggagcaggcttccatgctgctgtgggcgtccttgctggcctttgctccagtctgtggacaatctgcagctgcacacaaacctgtgatttccgtccatcctccatggaccacattcttcaaaggagagagagtgactctgacttgcaatggatttcagttctatgcaacagagaaaacaacatggtatcatcggcactactggggagaaaagttgaccctgaccccaggaaacaccctcgaggttcgggaatctggactgtacagatgccaggcccggggctccccacgaagtaaccctgtgcgcttgctcttttcttcagactccttaatcctgcaggcaccatattctgtgtttgaaggtgacacattggttctgagatgccacagaagaaggaaagagaaattgactgctgtgaaatatacttggaatggaaacattctttccatttctaataaaagctgggatcttcttatcccacaagcaagttcaaataacaatggcaattatcgatgcattggatatggagacgagaatgatgtatttagatcaaatttcaaaataattaaaattcaagaactatttccacatccagagctgaaagctacagactctcagcctacagaggggaattctgtaaacctgagctgtgaaacacagcttcctccagagcggtcagacaccccacttcacttcaacttcttcagagatggcgaggtcatcctgtcagactggagcacgtacccggaactccagctcccaaccgtctggagagaaaactcaggatcctattggtgtggtgctgaaacagtgaggggtaacatccacaagcacagtccctcgctacagatccatgtgcagcggatccctgtgtctggggtgctcctggagacccagccctcagggggccaggctgttgaaggggagatgctggtccttgtctgctccgtggctgaaggcacaggggataccacattctcctggcaccgagaggacatgcaggagagtctggggaggaaaactcagcgttccctgagagcagagctggagctccctgccatcagacagagccatgcagggggatactactgtacagcagacaacagctacggccctgtccagagcatggtgctgaatgtcactgtgagagagaccccaggcaacagagatggccttgtcgccgcgggagccactggagggctgctcagtgctcttctcctggctgtggccctgctgtttcactgctggcgtcggaggaagtcaggagttggtttcttgggagacgaaaccaggctccctcccgctccaggcccaggagagtcctcccattccatctgccctgcccaggtggagcttcagtcgttgtatgttgatgtacaccccaaaaagggagatttggtatactctgagatccagactactcagctgggagaagaagaggaagctaatacctccaggacacttctagaggataaggatgtctcagttgtctactctgaggtaaagacacaacacccagataactcagctggaaagatcagctctaaggatgaagaaagttaagagaatgaaaagttacgagaacgtcctactcatgtgatttctcccttgtccaaagtcccaggcccagtgcagtccttgcggcccctggaatgatcaactcattccagctttctaattcttctcatgcatatgcattcactcccaggaatactcattcgtctactctgatgttgggatggaatggcctctgaaagacttcactaaaatgaccaggatccacagttaagagaagaccctgtagtatttgctgtgggcctgacctaatgtattccctagggtctgctttagagaagggggataaagagagagaaggactgttatgaaaaacagaagcacaaattttggtgaattgggatttgcagagatgaaaaagactgggtgacctggatctctgcttaatacatctacaaccattgtctcactggagactcacttgcatcagtttgtttaactgtgagtggctgcacaggcactgtgcaaacaatgaaaagccccttcacttctgcctgcacagcttacactgtcaggattcagttgcagattaaagaacccatctggaatggtttacagagagaggaatttaaaagaggacatcagaagagctggagatgcaagctctaggctgcgcttccaaaagcaaatgataattatgttaatgtcattagtgacaaagatttgcaacattagagaaaagagacacaaatataaaattaaaaacttaagtaccaactctccaaaactaaatttgaacttaaaatattagtataaactcataataaactctgcctttaaaaaaagataaatatttcctacgtctgttcactgaaataattaccaaccccttagcaataagcactccttgcagagaggttttattctctaaataccattcccttctcaaaggaaataaggttgcttttcttgtaggaactgtgtctttgagttactaattagtttatatgagaataattcttgcaataaatgaagaaggaataaaagaaataggaagccacaaatttgtatggatatttcatgatacacctactggttaaataattgacaaaaaccagcagccaaatattagaggtctcctgatggaagtgtacaataccacctacaaattatccatgccccaagtgttaaaactgaatccattcaagtctttctaactgaatacttgttttatagaaaatgcatggagaaaaggaatttgtttaaataacattatgggattgcaaccagcaaaacataaactgagaaaaagttctatagggcaaatcacctggcttctataacaaataaatgggaaaaaaatgaaataaaaagaagagagggaggaagaaagggagagagaagaaaagaaaaatgaagaaaagtaattagaatattttcaacataaagaaaagacgaatatttaaggtgacagatatcccaactacgctgatttgatctttacaaattatatgagtgtatgaatttgtcacatgtatcacccccaaaaaaagagaaaaagaaaaatagaagacatataaattaaatgagacgagacatgtcgaccaaaaggaatgtgtgggtcttgtttggatcctgactcaaattaagaaaaaataaaactacctacgaaatactaagaaaaatttgtatactaatattaagaaattgttgtgtgttttggatataagtgatagtttattgtagtgatgtttttataaaagcaaaaggatattcactttcagcgcttatactgaagtattagattaaagcttattaacgta

SEQ ID NO: 2336 - DNA, 3386 bp, Homo sapiens
atctcagcccttggtggtccaggtcttcatgctgctgtgggtgatattactggtcctggtgccatcccctgggcaatttccaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgccttacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgagggtgctgccctggagcgtaggtcggccaactctgcaggaggagtggccatcagcttctctctgactgcagagcattcagggaactactactgcacagctgacaatggctttggcccccagcgcagtaaggcggtgagcctctccgtcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcagttccggtgtctcgcccggtcctcaccctcagggctcccgggacccatgctgcggtgggggacctgctggagcttcactgtgaggccctgagaggctctcccctgatcctgtaccggttttttcatgaggatgtcaccctaggaaataggtcgtccccctctggaggagcgtccttaaacctctctctgactgcagagcactctggaaactactcctgtgaggccgacaatggcctcggggcccagcgcagtgagacagtgacactttatatcacagggctgaccgcgaacagaagtggcccttttgccacaggagtcgccgggggcctgctcagcatagcaggccttgctgcgggggcactgctgctctactgctggctctcgagaaaagcagggagaaagcctgcctctgaccccgccaggagcccttcagactcggactcccaagagcccacctatcacaatgtaccagcctgggaagagctgcaaccagtgtacactaatgcaaatcctagaggagaaaatgtggtttactcagaagtacggatcatccaagagaaaaagaaacatgcagtggcctctgaccccaggcatctcaggaacaagggttcccctatcatctactctgaagttaaggtggcgtcaaccccggtttccggatccctgttcttggcttcctcagctcctcacagatgagtccacacgtctctccaactgctgtttcagcctctgcaccccaaagttccccttgggggagaagcagcattgaagtgggaagatttaggctgccccagaccatatctactggcctttgtttcacatgtcctcattctcagtctgaccagaatgcagggccctgctggactgtcacctgtttcccagttaaagccctgactggcaggttttttaatccagtggcaaggtgctcccactccagggcccagcacatctcctggattccttagtgggcttcagctgtggttgctgttctgagtactgctctcatcacacccccacagagggggtcttaccacacaaagggagagtgggccttcaggagatgccgggctggcctaacagctcaggtgctcctaaactccgacacagagttcctgctttg

SEQ ID NO: 2337 - DNA, 5390 bp, Homo sapiens
aattcactaatgcattctgctctttttgagagcacagcttctcagatgtgctccttggagctggtgtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgccttacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgagggtgctgccctggagcgtaggtcggccaactctgcaggaggagtggccatcagcttctctctgactgcagagcattcagggaactactactgcacagctgacaatggctttggcccccagcgcagtaaggcggtgagcctctccgtcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcagttccggtgtctcgcccggtcctcaccctcagggctcccgggacccatgctgcggtgggggacctgctggagcttcactgtgaggccctgagaggctctcccctgatcctgtaccggttttttcatgaggatgtcaccctaggaaataggtcgtccccctctggaggagcgtccttaaacctctctctgactgcagagcactctggaaactactcctgtgaggccgacaatggcctcggggcccagcgcagtgagacagtgacactttatatcacagggctgaccgcgaacagaagtggcccttttgccacaggagtcgccgggggcctgctcagcatagcaggccttgctgcgggggcactgctgctctactgctggctctcgagaaaagcagggagaaagcctgcctctgaccccgccaggagcccttcagactcggactcccaagagcccacctatcacaatgtaccagcctgggaagagctgcaaccagtgtacactaatgcaaatcctagaggagaaaatgtggtttactcagaagtacggatcatccaagagaaaaagaaacatgcagtggcctctgaccccaggcatctcaggaacaagggttcccctatcatctactctgaagttaaggtggcgtcaaccccggtttccggatccctgttcttggcttcctcagctcctcacagatgagtccacacgtctctccaactgctgtttcagcctctgcaccccaaagttccccttgggggagaagcagcattgaagtgggaagatttaggctgccccagaccatatctactggcctttgtttcacatgtcctcattctcagtctgaccagaatgcagggccctgctggactgtcacctgtttcccagttaaagccctgactggcaggttttttaatccagtggcaaggtgctcccactccagggcccagcacatctcctggattccttagtgggcttcagctgtggttgctgttctgagtactgctctcatcacacccccacagagggggtcttaccacacaaagggagagtgggccttcaggagatgccgggctggcctaacagctcaggtgctcctaaactccgacacagagttcctgctttgggtggatgcatttctcaattgtcatcagcctggtggggctactgcagtgtgctgccaaatgggacagcacacagcctgtgcacatgggacatgtgatgggtctccccacgggggctgcatttcacactcctccacctgtctcaaactctaaggtcggcacttgacaccaaggtaacttctctcctgctcatgtgtcagtgtctacctgcccaagtaagtggctttcatacaccaagtcccaagttcttcccatcctaacagaagtaacccagcaagtcaaggccaggaggaccaggggtgcagacagaacacatactggaacacaggaggtgctcaattactatttgactgactgactgaatgaatgaatgaatgaggaagaaaactgtgggtaatcaaactggcataaaatccagtgcactccctaggaaatccgggaggtattctggcttccctaagaaacaatggaagagaaggagcttggatgaggaaactgttcagcaagaggaagggcttctcacactttcatgtgcttgtggatcacctgaggatcctgtgaaaatacagatactgattcagtgggtctgcgtagagcctgagactgccattctaacatgttcccaggggatgctgatgctgctggccctgggactgcactgcatgcatgtgaagccctataggtctcagcagaggcccatggagagggaatgtgtggctctggctgcccagggcccaactcggttcacacggatcgtgctgctccctggccagcctttggccacagcaccaccagctgctgttgctgagagagcttcttctctgtgacatgttggctttcatcagccaccctgggaagcggaaagtagctgccactatctttgtttccccacctcaggcctcacactttcccatgaaaagggtgaatgtatataacctgagccctctccattcagagttgttctcccatctctgagcaatgggatgttctgttccgcttttatgatatccatcacatcttatcttgatctttgctcccagtggattgtacagtgatgacttttaagccccacggccctgaaataaaatccttccaagggcattggaagctcactccacctgaaccatggcttttcatgcttccaagtgtcagggccttgcccagatagacagggctggctctgctgccccaacctttcaaggaggaaaccagacacctgagacaggagcctgtatgcagcccagtgcagccttgcagaggacaaggctggaggcatttgtcatcactacagatatgcaactaaaatagacgtggagcaagagaaatgcattcccaccgaggccgcttttttaggcctagttgaaagtcaagaaggacagcagcaagcataggctcaggattaaagaaaaaaatctgctcacagtctgttctggaggtcacatcaccaacaaagctcacgccctatgcagttctgagaaggtggaggcaccaggctcaaaagaggaaatttagaatttctcattgggagagtaaggtacccccatcccagaatgataactgcacagtggcagaacaaactccaccctaatgtgggtggaccccgtccagtctgttgaaggcctgaatgtaacaaaagggcttattcttcctcaagtaagggggaactcctgctttgggctgggacataagtttttctgctttcagacgcaaactgaaaaatggctcttcttgggtcttgagcttgctggcatatggactgaaagaaactatgctattggatctcctggatctccagcttgctgactgcagatcttgagatatgtcagcctctacagtcacaagagctaattcattctaataaaccaatctttctgta

SEQ ID NO: 2338 - DNA, 403 bp, Homo sapiens
atctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagagatgggatttcctcatgctgcccaggctaatgttgaactcctgggctcaagtgatctgctcacctag

SEQ ID NO: 2339 - DNA, 4424 bp, Homo sapiens
gtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgccttacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgagggtgctgccctggagcgtaggtcggccaactctgcaggaggagtggccatcagcttctctctgactgcagagcattcagggaactactactgcacagctgacaatggctttggcccccagcgcagtaaggcggtgagcctctccgtcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactggtaagtgctgggttcttgccagtcacccacccctggctgagttctctctcacccattcctttaaaaatctgtttgcactgtccagtttcctcccctaatcaacttaatccccttcttggcttcctcctcaactaactagctggggttttccgtactcataagtcctggctcagccagacccctaaaacagctcagtagattccccagcttttaccaaatgaatttatttattgtattttctcctcattccttgtatgttccaacagtacgccaatttttcttgatgcacggagcgtgtcctacttctctactgacatttacatattaacttagctacaagcacagtcttatagataaatattggtcaagaccttaaattctccaaaggatttccaatcttatggtagatttggagaaagctgctggtgaacaaagggggaaatggctccctaggaaccaactcctcaaacttctggagtttttatgatcccttgttttctaacctgctaaaatcagtatcattttattgtattattttaaaaaaactattgttgaagtatgacatacattcaagaaacgtgtgcaaattgtatgtgtacgatttggtgtctttttaggagctaagttgcttctgtttttacttgaatctttgtttatagaaactgggggaaagtttactttcttttcagagaagccaaatggtatgatagaaaaatcttgagcctgatgtgtcagacatgcccctagcataacttgttgagtaaagaggttatttttaaaatgtgaatgttctgagactactccaaagtcagagccaaatctactaggaagcttctagacttcactcattctgcatcccattactatctttttatccatgttttactttcttctcatattcagcagcatcttaagcctctttattttctgtttcttgactgtcacccttaatgccagtagaatgtaagcttcatgagaacagaactgcatccatcttggtcttcacaacatccctgtgcctactcagtgtttggcacacagtaggtcctcagtcaacatttgtaatttagtggacagatgatatgacaagatgataagaggggatttaaaaaaatcatctagcaaagcccaagaggaaaaaaaacaaagctattttagaaatgaaataccaatttgaagcagtaagaatagattggatatctttgaaaaccattaattgaatgaagaaccaatttgagaaaacaatacagaatgcaaagtagaaagatacagaaataaaggcaaaaattataatatggaaatcagacaatggatttgtctgtatccagttatgtggataattaaaatggagaccctcagaaaattgaaccgaagagtaaaatgaaactcaaaaatgtagtagaaattgttgggaagtaaagaaaacttgaatatgtagatcagaacatatatgttgatgacgttattgactttgaggttaaaaatatatatatgtgcctatgattatggggaaaaaagcagtcgtctcagaaagaaaaacatcaagttagtcttagactttgcagtgcactcaataccaaagagagaggaggtccagacttggacctgcgagggaagaataataaccgaaaattttatatcaattcaaaaagacattgtcaaaaatacagggattcaggaaactgagaatgcactaagccttctggaaaaaacacctaatgacaaaatctagcccaacaagatgtaaatgaatataaaggactcataatgaggaaaccgcattatgactggctctcaaccctggctgcatattagactcgtcaaagacctttgtaaaaggtcacacattgactcgtcaaagcccctctccagactaattcaattcagaatctcacagatggggccacagaatcagtattttttgacacaacctcaagtgagaatattgtgtagacaagattggaaaccactgatttagatatagaaacaaaggctaatcaactgtgagaattatggtcacagaatagaaagtaactattatgaacactgaaaatgtaaaaaaaatgtaacaaagaaaaatagttagaggaaggagaggaagtaaaggaacaatcattttctcatgattattattatttcagagtaaattgtgagttatttcacaattcaaaaagaatggactgttttaaaaaattagtaatagatttcaaaatgtccattttgtaaatcgtttctgaatactttgtcaacagttactcatcattaatggcttatacttcactaaaattccatggaaaaccaactagtagcctgtagagtcacataggagagaacaagtgaattctttgggtggcgcaagcatagatgttaggactgacaaaaaaaaaataataaaaataaacctgtgcattgatatgatcacaaatgatcagggaaagaggaaacagaaactctcatacgccattattacaagcgtaaattggttcaaccttttcgtcttaattgacacattgtaattgtatatatttatggaagcacagtttgatattttgatatacatacatggtatataacgatcaaattaggatatttaatgtacccatcatctcatgcatttatcatttctttggaataaaaacattcaaaagcc

SEQ ID NO: 2340 - DNA, 2800 bp, Homo sapiens
gtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgccttacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgagggtgctgccctggagcgtaggtcggccaactctgcaggaggagtggccatcagcttctctctgactgcagagcattcagggaactactactgcacagctgacaatggctttggcccccagcgcagtaaggcggtgagcctctccgtcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcaggtgagtgggccctgcccaccagcagcacatctgagaactgactgtgcctgttctccctgcagctgaaaatggagccacagagctcctcagggctgtttgcttgtgtggcatcccagcacacttcctgcctgcagaacctccctgtgaaagtctcggatcctttgtggtatggttccaggaatctgatgtttcccagcagtcttcttgaagatgatcaaagcacctcactaaaaatgcaaataagacttttttagaacataaactatattctgaactgaaattattacatgaaaatgaaaccaaagaattctgagcatatgtttctctgccgtagaaaggattaagctgtttcttgtccggattcttctctcattgacttctaacaagcctctactcttgagtctctttcattactggggatgtaaatgttccttacatttccacattaaaaatcctatgttaacataa

SEQ ID NO: 2341 - DNA, 2352 bp, Homo sapiens
gagagcacagcttctcagatgtgctccttggagctggtgtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgccttacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgagggtgctgccctggagcgtaggtcggccaactctgcaggaggagtggccatcagcttctctctgactgcagagcattcagggaactactactgcacagctgacaatggctttggcccccagcgcagtaaggcggtgagcctctccgtcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcaggtgagtgggccctgcccaccagcagcacatctgagaactgactgtgcctgttctccctgcagctgaaaatggagccacagagctcctcagggctgtttgcttgtgtggcatcccagcacacttcctgcctgcagaacctccctgtgaaagtctcggatcctttgtggtatggttccaggaatctgatgtttcccagcagtcttcttgaagatgatcaaagcacctcactaaaaatgc

SEQ ID NO: 2342 - DNA, 1422 bp, Homo sapiens
caggccccatgctgctctggacggctgtgctgctctttgttccctgtgttgggaaaactgtctggctgtacctccaagcctggccaaaccctgtgtttgaaggagatgccctgactctgcgatgtcagggatggaagaatacaccactgtctcaggtgaagttctacagagatggaaaattccttcatttctctaaggaaaaccagactctgtccatgggagcagcaacagtgcagagccgtggccagtacagctgctctgggcaggtgatgtatattccacagacattcacacaaacttcagagactgccatggttcaagtccaagagctgtttccacctcctgtgctgagtgccatcccctctcctgagccccgagagggtagcctggtgaccctgagatgtcagacaaagctgcaccccctgaggtcagccttgaggctccttttctccttccacaaggacggccacaccttgcaggacaggggccctcacccagaactctgcatcccgggagccaaggagggagactctgggctttactggtgtgaggtggcccctgagggtggccaggtccagaagcagagcccccagctggaggtcagagtgcaggctcctgtatcccgtcctgtgctcactctgcaccacgggcctgctgaccctgctgtgggggacatggtgcagctcctctgtgaggcacagaggggctcccctccgatcctgtattccttctaccttgatgagaagattgtggggaaccactcagctccctgtggtggaaccacctccctcctcttcccagtgaagtcagaacaggatgctgggaactactcctgcgaggctgagaacagtgtctccagagagaggagtgagcccaagaagctgtctctgaagggttctcaagtcttgttcactcccgccagcaactggctggttccttggcttcctgcgagcctgcttggcctgatggttattgctgctgcacttctggtttatgtgagatcctggagaaaagctgggccccttccatcccagataccacccacagctccaggtggagagcagtgcccactatatgccaacgtgcatcaccagaaagggaaagatgaaggtgttgtctactctgtggtgcatagaacctcaaagaggagtgaaggacagttctatcatctgtgcggaggtgagatgcctgcagcccagtgaggtttcatccacggaggtgaatatgagaagcaggactctccaagaaccccttagcgactgtgaggaggttctctgctagtgatggtgttctcctatcaacacacgcccacccccagtctccagtgctcctcaggaagacagtggggtcctcaactctttctgtgggtccttcagttcccaagcccagcatcacagagccccctgagcccttgtcctggtc

SEQ ID NO: 2343 - DNA, 1306 bp, Homo sapiens
catgctgctctggacggctgtgctgctctttgttccctgtgttgggaaaactgtctggctgtacctccaagcctggccaaaccctgtgtttgaaggagatgccctgactctgcgatgtcagggatggaagaatacaccactgtctcaggtgaagttctacagagatggaaaattccttcatttctctaaggaaaaccagactctgtccatgggagcagcaacagtgcagagccgtggccagtacagctgctctgggcaggtgatgtatattccacagacattcacacaaacttcagagactgccatggttcaagtccaagagctgtttccacctcctgtgctgagtgccatcccctctcctgagccccgagagggtagcctggtgaccctgagatgtcagacaaagctgcaccccctgaggtcagccttgaggctccttttctccttccacaaggacggccacaccttgcaggacaggggccctcacccagaactctgcatcccgggagccaaggagggagactctgggctttactggtgtgaggtggcccctgagggtggccaggtccagaagcagagcccccagctggaggtcagagtgcaggctcctgtatcccgtcctgtgctcactctgcaccacgggcctgctgaccctgctgtgggggacatggtgcagctcctctgtgaggcacagaggggctcccctccgatcctgtattccttctaccttgatgagaagattgtggggaaccactcagctccctgtggtggaaccacctccctcctcttcccagtgaagtcagaacaggatgctgggaactactcctgcgaggctgagaacagtgtctccagagagaggagtgagcccaagaagctgtctctgaagggttctcaagtcttgttcactcccgccagcaactggctggttccttggcttcctgcgagcctgcttggcctgatggttattgctgctgcacttctggtttatgtgagatcctggagaaaagctgggccccttccatcccagataccacccacagctccaggtggagagcagtgcccactatatgccaacgtgcatcaccagaaagggaaagatgaaggtgttgtctactctgtggtgcatagaacctcaaagaggagtgaagccaggtctgctgagttcaccgtggggagaaaggacagttctatcatctgtgcggaggtgagatgcctgcagcccagtgaggtttcatccacggaggtgaatatgagaagcaggactctccaagaaccccttagcgactgtgaggaggttctctgctag

SEQ ID NO: 2344 - DNA, 947 bp, Homo sapiens
catgctgctctggacggctgtgctgctctttgttccctgtgttgggaaaactgtctggctgtacctccaagcctggccaaaccctgtgtttgaaggagatgccctgactctgcgatgtcagggatggaagaatacaccactgtctcaggtgaagttctacagagatggaaaattccttcatttctctaaggaaaaccagactctgtccatgggagcagcaacagtgcagagccgtggccagtacagctgctctgggcaggtgatgtatattccacagacattcacacaaacttcagagactgccatggttcaagtccaagctcctgtatcccgtcctgtgctcactctgcaccacgggcctgctgaccctgctgtgggggacatggtgcagctcctctgtgaggcacagaggggctcccctccgatcctgtattccttctaccttgatgagaagattgtggggaaccactcagctccctgtggtggaaccacctccctcctcttcccagtgaagtcagaacaggatgctgggaactactcctgcgaggctgagaacagtgtctccagagagaggagtgagcccaagaagctgtctctgaagggttctcaagtcttgttcactcccgccagcaactggctggttccttggcttcctgcgagcctgcttggcctgatggttattgctgctgcacttctggtttatgtgagatcctggagaaaagctgggccccttccatcccagataccacccacagctccaggtggagagcagtgcccactatatgccaacgtgcatcaccagaaagggaaagatgaaggtgttgtctactctgtggtgcatagaacctcaaagaggagtgaagccaggtctgctgagttcaccgtggggagaaagttctatcatctgtgcggaggtgagatgcctgcagcccagtgaggtttcatcc

SEQ ID NO: 2345 - DNA, 3629 bp, Homo sapiens
gggagaggactctgcgggcgaagtggctgcgcaaggagagaacttttcctgcacaaggaacgcctcgtggggagacccaaggcaggagcggtccggagccggctgcggcgtgtgcggccggccttgggacagcgatcgccgcgggtggcaacagagagccccaagcaaaagtgggagcaggagcttggaggtgagcacaggaagccccacttgaggcttttacgcagcctctagtctctgtttcttctggaataggcaagtgtcctttcaactctaagagaccagcagaggccactgtcccttaagactgccggagtcctcaccacttctccaggattccagaggagactgtggcgatggtgaatgaaggtcccaaccaggaagagagcgatgacacccctgtgccggagtccgcactccaagcggaccccagcgtctcggtccatcccagcgtctcggtccatcccagcgtctccatcaaccccagcgtctctgtccaccccagcagttcggcccaccccagtgccttagcccaacccagtggcttggctcaccccagtagctcgggccctgaggacctcagcgtgatcaaggtgagcaggcgccgttgggccgtggtcctggtgtttagctgctactccatgtgcaactcctttcagtggatccagtacggctccatcaataacatcttcatgcacttctacggtgtcagtgcctttgccattgactggctgtccatgtgctacatgctgacttacatccctctgctcctgccagtggcttggctgctggagaagttcggcctgcgcaccattgctctcactggctcggctctcaactgcctgggggcctgggtgaagctgggcagcctgaagccgcatctctttccggtcaccgtggtgggccagctcatctgctctgtggcccaggttttcatcctgggcatgccctcccgcatcgcttccgtctggttcggggctaatgaggtttcaacagcctgctccgtggctgtctttggcaatcagcttggaattgcgattgggttcttggtccctcctgttttggtacccaacattgaagaccgggacgagcttgcctaccacatcagcatcatgttctatataataggaggtgtggccactctcctcctcatccttgtcatcattgtgttcaaggagaaacctaaatatccccccagcagggcccaatccctgagctatgccttgacctctcctgatgcctcatacttaggttccatcgcccggctcttcaaaaatctcaactttgtgctgcttgtcatcacctatggtctgaatgctggtgctttttatgccttgtccactcttctgaatcgcatggtgatctggcactacccgggggaagaagtgaatgctggaagaattggcctgacgatcgtcattgcaggaatgcttggggctgtgatctcaggaatctggctggataggtccaaaacctacaaagagacaaccctggtagtctatatcatgacactggtgggcatggtggtgtacacgtttaccttgaacctgggacacctgtgggtagtgttcatcactgctggcacaatgggcttctttatgactggctatctcccactgggatttgagtttgctgtggagctcacgtacccagaatcagaaggcatctcctccggcctcctcaacatatctgcacaggtatttgggatcatctttaccatctcccagggccagattattgacaactatggaaccaagcctgggaacatcttcctgtgtgtgttccttactcttggagcagccctcactgcattcattaaggcagatctccggagacagaaagcaaacaaagaaactcttgagaacaaactccaagaggaggaggaggagagcaacaccagcaaagtgcccactgctgtgtcagaggatcatctctgagaggaaggtggtgacaactcagggaacacgaacaccccaccttttccttcagcacagctctcaccgccagcacaaagggcttcgctagagatgtttttggagggaatcagtgggactatttgtggcatggatggcctattcctcctagaacccacgtaagagcttggatgatttagttggagaaaattgcacctatcaccaaatgcaaatttgattcccacctccacccccttttaggttatgggagttggtgttgggacagggtggcagagaatattggagtcaatcctagcttggtctcttgccttccctcttttcctccatccatcgtggacaatgcctgcaaaattttcacaggaagaaagcctattcaggatattaacttgaaatttccagtgtcctaagagcctctcatgaagcccagttctaataagtggcaagctgctctgccggggtcatctcctgggtcatcggactgattgctcaagttctgcaggagaggaagcaccattagaacaactccatcagaacagctccaccgggacttgtgggcctaaattttcctggcctaacgggtctgtctccaaaccctctttcctaagagctgagcaaaccaaccataataaacttgacaaaagactttgttgtggccatgacagagataccgactcaggagggctacctacctaggtgtgatcatgctgggggctaccttctgagtatatttgtgaaagcacatatttgggaactctggtagcttgagttgggaatgggaaggttcttttttacagaagtacttccccagggacttctgtgtgtcacagtcacctctgatgcctttatcttgatgttgcattgggaatctcagccatcagcccaagtgcttgttttattccaaggcagggtaatccccgtcaacttactctaacctttgctgaaaactaatcttgattcattctactctgaaaatccaaaggtgcttctgagagataagagggaaggggtagaaggaaaggtgccccttgaaatgggaattgagcctgttagaattaaaagcttatctcacctctgctggggacagtatttgcaccaccaacccctctcctcacctgctttgagcgataatctttatcagatattctaaacttaaagggattccctttaaaccaactcaagctgatctttcctatctagcctgctgtttggctgtactcatgggctttggtaatatctcctaaaaatgaggttttggtaatttttcctatgcattgggcaactgtgatcgtgaccactgtgctgtcttgctccagccactgccctggcctcagcatatcagggcagcctgtgctggctgcaatactgtggtgcttgggccactgcctgagaggagccaggtttgtgtgtgtctgcatgtgtgtgtgtgtgtgtttgtacagattcaagcaatggatgcaaggaacatgctgtatgtaatagaagaaagaagtccacgttttcggcagaagtagtgagtcagtgtggaagagaggtgagggtgtgctttactttttgataaagagaaagatgtttactcataaacccttcaaaaggtattaacaaaatgtttaccaaacctattgctttattttaaaaacataatttgtgttttctatttgtaagatctgacatttcgaggcaataaaaacttctcag

SEQ ID NO: 2346 - DNA, 1221 bp, Homo sapiens
acttctgctttctgacttgattacaggcatctttcctttttcatgctgtgcaaaaacttgagctcagcctctcaccccaacacaattcaagacgcagccttgtcccagcatgagcgcagataacagcagcaccatctgtgtttgtagaagcgtgagacaggagcttggaattgcgattgggttcttggtccctcctgttttggtacccaacattgaagaccgggacgagcttgcctaccacatcagcatcatgttctatataataggaggtgtggccactctcctcctcatccttgtcatcattgtgttcaaggagaaacctaaatatccccccagcagggcccaatccctgagctatgccttgacctctcctgatgcctcatacttaggttccatcgcccggctcttcaaaaatctcaactttgtgctgcttgtcatcacctatggtctgaatgctggtgctttttatgccttgtccactcttctgaatcgcatggtgatctggcactacccgggggaagaagtgaatgctggaagaattggcctgacgatcgtcattgcaggaatgcttggggctgtgatctcaggaatctggctggataggtccaaaacctacaaagagacaaccctggtagtctatatcatgacactggtgggcatggtggtgtacacgtttaccttgaacctgggacacctgtgggtagtgttcatcactgctggcacaatgggcttctttatgactggctatctcccactgggatttgagtttgctgtggagctcacgtacccagaatcagaaggcatctcctccggcctcctcaacatatctgcacaggtatttgggatcatctttaccatctcccagggccagattattgacaactatggaaccaagcctgggaacatcttcctgtgtgtgttccttactcttggagcagccctcactgcattcattaaggcagatctccggagacagaaagcaaacaaagaaactcttgagaacaaactccaagaggaggaggaggagagcaacaccagcaaagtgcccactgctgtgtcagaggatcatctctgagaggaaggtggtgacaactcagggaacacgaacaccccaccttttccttcagcacagctctcaccgccagcacaaagggcttcgctagagatgtttttggagggaatcagtgggactatttgtggcatggatggcctattcctcct

SEQ ID NO: 2347 - DNA, 5859 bp, Homo sapiens
ttttcagaaaggggatgtttgggctgaaggtgaagaagaagagaaataaggcagagaaggggttaatcctagccaacaaggctgcgaaagatagtcaaggtgacactgaagcactgcaggaggagccttctcaccaggaaggaccgagaggagatttggtccatgatgatgcttctatctttcctgtcccctcagcttctccaaagagaagatcaaaactgttgactaagatccatgatggggaggtcagatcccaaaattatcaaattgccataaccatcaccgaggctcgccagctggtgggtgagaacattgacccagttgtgaccattgagattggggatgagaagaagcaaagcacagtgaaggaaggaaccaacagcccattttataatgaatactttgtcttcgacttcattgggccccaagtgcatctttttgacaagatcatcaaaatctccgtctttcaccacaagctgataggaagtgtactgattggctctttcaaagtagacctggggaccgtgtacaaccaacctggtcatcagttctgcaacaagtgggccctgctcacagaccctggtgacatcaggactggcaccaaggggtacctgaaatgtgacatcagtgtcatgggaaaaggtgatgtcttgaagaccagccctaaaacttctgacaccgaggagccaatagaaaagaaccttttgatccccaatgggtttccactggagagaccgtgggccagattctatgtgagactctacaaagcagaagggttgcccaaaatgaattcaagcatcatggcgaacgtcaccaaggcatttgtgggtgacagtaaggacctggtggatccctttgtggaggtctcctttgctgggcagatggggcgaaccacagtgcagaagaactgtgctgatcctgtgtggcatgaacaggtgatcttcaaggaaatgttccctcccttgtgtcggagggtgaaaatccaggtgtgggatgaaggcagcatgaatgacgtagccctggcaacccatttcattgacctgaagaaaatctccaacgaacaggatggagacaaaggctttctgcccacctttgggcctgcctggattaacctgtatggctcgcccaggaaccacagtctgatggatgactaccaggaaatgaacgaaggctttggggaaggtgtgtcattcaggggcagaatcttggtagaaattgctgtggaaatcctctcaggacgggcacaggaatctaaattttccaaggccctgaaggagctcaagttgccttccaaggacaaagactccaaatcttccaaaggtaaagacaaggctgacaaaactgaagatggaaaatcccaacaggcttcaaacaaaactaactcaaccgaggtggaggtggaatcgttcgatgtccccccggagattgtaccagaaaaaaatgaggaatttttactctttggagcattttttgaagctaccatgattgaccggaagattggagataaacccatcagctttgaagtttctattggtaattttggaaacctgattgatggaggatcccatcatgggagtaagaagtcagctgaatcagctgaagaagacctccttccactgcttcacgaagggcaaggggatgtggcccatgatgttcccattcctatggcctccaccactcacccggagaagccactggtgacagaagggaacaggaattacaactatttgccatttgaggctaagaagccctgtgtctatttcatcagctcttggggagaccagaccttcaggctgcactggtccaacatgctggagaaaatggcagacttcctggaagaaagtatagaagaagtgagagaattgatcaagatttcacaggaggcacctgaagagaaaatgaaaacagtgctcagtgacttcatcagtcggagcagtgcctttatctctgaagcagaaaaaaagcccaagatgttgaaccaaaccactttagataagaagcgacttacgctctgctggcaggagctggaagcaatgtgcaaggaggccaaggggatcattcagcagcagaagaaaaagttatctgttgatgaaatgattcacgaagcccaaaactttgtggaaaaaatccgctttcttgttgatgagccccagcacactatccctgacgttttcatctggatgctcagcaacaacaggagagtggcctatgcccgcatcgcctccaaagacctcctctattcccctgtcgcggggcagatgggcaaacactgcggcaagatcaaaactcacttcctcaaacctcctgggaaacgaccggctggttggtctgtgcaagcaaaagtcgacgtgtacctgtggctgggctccatcaagcatgccagtgccattttggacaacttgccagtaggctatgaagcagaaatgtcctccaaaggggctggcaccaatcaccccccatctaacctgctctaccaagaacagcatgtttttcagctgagggctcacatgtaccaagcccggggcctcatcgcagctgacagcaatggactttcagacccttttgccaaagtcacgttcctttctcactgccagacaacaaagataatctcccagaccctctctccgacctggaaccagatgctgctgttcaatgatttggtgctgcatggagatgtgaaggagctggcagagtccccgcccttagtggtggtggagctgtatgacagcgacgctgtggggaagccagaatatttgggtgccacagtggctgctcctgttgtgaagctggctgaccaggactatgagccccccaggttatgctatcaccccatcttttgtgggaatctctctggaggggatctccttgctgtatttgaactgctgcaggttcctccttctgggctgcaaggcctcccacccgttgagccaccagacatcacccagatctacccggttcctgccaacattcggccggtgctgagcaaataccgagtggaggttctcttctggggagttcgggaaatgaagaaggtgcagctcctctctgtggatcggcctcaggctctcattgagtgcggaggacaaggtgtgaagtcctgcgtgatccagagctacaagaacaacccgaacttcagcatccaggcagacgctttcgaagtggaactgcctgagaacgagcttctgcacccgccactgagcatctgcgtggtggactggagagcttttgggaggagtacccttgtgggcacctacaccatcaactacttgaagcagtttttgtgtaaactcagagagccccttgcccccatcacacaggtggatggaacccagcctgggcacgatatttcagattcgctaacagccactgagtcctctggagcccacagctcctcccaggatcccccagcagatcacatttatgtggatgttgagccacctcccacagtggtgcccgactctgcccaggcccagccggccatcctggttgacgtccctgactcatccccgatgctggagcctgaacacacacctgtagcccaggagccaccaaaagatggaaaacctaaggatcccaggaagccttcccggaggtccactaagaggagaaagaggaccatagcagatgaatctgctgaaaacgtgattgactggtggtctaagtattatgcctccctgaagaaagcccagaaggcaaaggagagaaatcccaagggaaaaaaaggcaatacagaggcaaagccagatgaggtagtggtagatatagaagatgggccaaagaagaagaaagacaaaatgctcaagaagaaacccaaagatgatggaatccccaacctggccatcttgcagatatatgacggtgatctcgagagtgaattcaacaattttgaagactgggtgaaaacttttgagctcttcagaggcaagtctacggaagatgaccatggtcttgatggagaccgagtcataggaaaatttaagggctccttctgcatctacaaaagcccccaggattctagctctgaggacagcgggcagctgagaatccagcaagggattccgcccaatcaccctgtcacagtgctgatcagagtatacattgtcgcggcatttaatcttagtccagctgatccagatggcaaatcagatccctacattgtgatcaagcttggcaagacagaaatcaaagaccgggataaatacatccctaaacaactgaacccagtatttggaaggtcatttgagatccaagccacattcccaaaagagtccctgctctccatcctgatctatgaccatgacatgattggcacagatgaccttattggtgagaccaagatcgacctggagaaccgcttctacagcaaacaccgagccatctgtggcttgcagagccagtatgagatagaaggatacaatgcctggagagacacgtccaaacccaccgaaatcctcactaagctctgcaaagacaacaagctggatggaccctactttcaccctgggaaaatacagataggaaaccaagtcttttctggaaaaactatcttcactgaagaggacactgatgagacagtggagtcttatgaacacctggccctcaaggttttacactcttgggaggatatcccggaagtcgggtgtaggctggttcctgaacacatagaaactcggccactgtaccacaaggataagccaggaatggagcagggccgcctgcagatgtgggtggacatgtttcccaaggatatgcctcaacctggacctcctgttgacatctctccaaggcgacccaaaggatacgaattgagagtgaccatctggaacactgaagatgtcattttagaggatgagaatatcttcacaggccaaaaatcaagtgatatttatgtgaaagggtggttaaagggcttggaggatgacaagcaggagacagatgtgcattacaactccctgactggagagggcaacttcaactggcgcttcctgtttccctttcagtatctcccagctgagaagcaaatggtcattaccaagagggagaacatcttctctttagagaagatggagtgtaagactcctgctgtgttggtgctgcaggtttgggattttgaaaggctgtcctcagatgacttcctgggcaccctggaaatgaacctcaacagtttccctcgagcagctaagtctgccaaagcctgtgatcttgccaagtttgaaaatgcaagtgaggagaccaagatctctatattccagcaaaaacgtgtgcgtggctggtggcctttttctaaaagcaaagaactcacaggcaaggttgaagctgagttccacctagttacagcagaagaagctgagaaaaatcctgttggaaaagcccgaaaggagccagagcccctggccaagcccaaccgcccagacacctccttttcgtggttcatgagcccctttaagtgcctgtactacctcatctggaagaattacaaaaagtacatcatcattgctttcattctcatcatcctcatcatcttcctcgtccttttcatctacaccttgccaggagccatcagccgaaggatcgttgtgggctcatagaggatcatggaggacccagatcctcgccatatactaatcctctcttccttatctgggagcatctaagaacatgtcccatgcatggcactgtgctgagtgctaaggggacagatcaacccttcttggaagagatggaaaagaaacatttcctccctgctccaacccctgcctccaagtttcaaacttgtaaggcatgttttatcccttgggcagcatgaaataaggcactttcacctcatggtaatcaacaatgacctcaaattgacttaga

SEQ ID NO: 2348 - DNA, 6051 bp, Homo sapiens
tggtgaggttgcctgtaactgacttcaaaaggccattccaccattccgtcaagccagctgctttagaacggttgggaacaccgtgagaccagtgaattccacgagcacgaacccactgctgcgcttcatttgctgtgaagtgagtcccttgatcagagcaatgctgtgtggaccatcgtgaaggtggacaaggcattttaaaggggatgtttgggctgaaggtgaagaagaagagaaataaggcagagaaggggttaatcctagccaacaaggctgcgaaagatagtcaaggtgacactgaagcactgcaggaggagccttctcaccaggaaggaccgagaggagatttggtccatgatgatgcttctatctttcctgtcccctcagcttctccaaagagaagatcaaaactgttgactaagatccatgatggggaggtcagatcccaaaattatcaaattgccataaccatcaccgaggctcgccagctggtgggtgagaacattgacccagttgtgaccattgagattggggatgagaagaagcaaagcacagtgaaggaaggaaccaacagcccattttataatgaatactttgtcttcgacttcattgggccccaagtgcatctttttgacaagatcatcaaaatctccgtctttcaccacaagctgataggaagtgtactgattggctctttcaaagtagacctggggaccgtgtacaaccaacctggtcatcagttctgcaacaagtgggccctgctcacagaccctggtgacatcaggactggcaccaaggggtacctgaaatgtgacatcagtgtcatgggaaaaggtgatgtcttgaagaccagccctaaaacttctgacaccgaggagccaatagaaaagaaccttttgatccccaatgggtttccactggagagaccgtgggccagattctatgtgagactctacaaagcagaagggttgcccaaaatgaattcaagcatcatggcgaacgtcaccaaggcatttgtgggtgacagtaaggacctggtggatccctttgtggaggtctcctttgctgggcagatggggcgaaccacagtgcagaagaactgtgctgatcctgtgtggcatgaacaggtgatcttcaaggaaatgttccctcccttgtgtcggagggtgaaaatccaggtgtgggatgaaggcagcatgaatgacgtagccctggcaacccatttcattgacctgaagaaaatctccaacgaacaggatggagacaaaggctttctgcccacctttgggcctgcctggattaacctgtatggctcgcccaggaaccacagtctgatggatgactaccaggaaatgaacgaaggctttggggaaggtgtgtcattcaggggcagaatcttggtagaaattgctgtggaaatcctctcaggacgggcacaggaatctaaattttccaaggccctgaaggagctcaagttgccttccaaggacaaagactccaaatcttccaaaggtaaagacaaggctgacaaaactgaagatggaaaatcccaacaggcttcaaacaaaactaactcaaccgaggtggaggtggaatcgttcgatgtccccccggagattgtaccagaaaaaaatgaggaatttttactctttggagcattttttgaagctaccatgattgaccggaagattggagataaacccatcagctttgaagtttctattggtaattttggaaacctgattgatggaggatcccatcatgggagtaagaagtcagctgaatcagctgaagaagacctccttccactgcttcacgaagggcaaggggatgtggcccatgatgttcccattcctatggcctccaccactcacccggagaagccactggtgacagaagggaacaggaattacaactatttgccatttgaggctaagaagccctgtgtctatttcatcagctcttggggagaccagaccttcaggctgcactggtccaacatgctggagaaaatggcagacttcctggaagaaagtatagaagaagtgagagaattgatcaagatttcacaggaggcacctgaagagaaaatgaaaacagtgctcagtgacttcatcagtcggagcagtgcctttatctctgaagcagaaaaaaagcccaagatgttgaaccaaaccactttagataagaagcgacttacgctctgctggcaggagctggaagcaatgtgcaaggaggccaaggggatcattcagcagcagaagaaaaagttatctgttgatgaaatgattcacgaagcccaaaactttgtggaaaaaatccgctttcttgttgatgagccccagcacactatccctgacgttttcatctggatgctcagcaacaacaggagagtggcctatgcccgcatcgcctccaaagacctcctctattcccctgtcgcggggcagatgggcaaacactgcggcaagatcaaaactcacttcctcaaacctcctgggaaacgaccggctggttggtctgtgcaagcaaaagtcgacgtgtacctgtggctgggctccatcaagcatgccagtgccattttggacaacttgccagtaggctatgaagcagaaatgtcctccaaaggggctggcaccaatcaccccccatctaacctgctctaccaagaacagcatgtttttcagctgagggctcacatgtaccaagcccggggcctcatcgcagctgacagcaatggactttcagacccttttgccaaagtcacgttcctttctcactgccagacaacaaagataatctcccagaccctctctccgacctggaaccagatgctgctgttcaatgatttggtgctgcatggagatgtgaaggagctggcagagtccccgcccttagtggtggtggagctgtatgacagcgacgctgtggggaagccagaatatttgggtgccacagtggctgctcctgttgtgaagctggctgaccaggactatgagccccccaggttatgctatcaccccatcttttgtgggaatctctctggaggggatctccttgctgtatttgaactgctgcaggttcctccttctgggctgcaaggcctcccacccgttgagccaccagacatcacccagatctacccggttcctgccaacattcggccggtgctgagcaaataccgagtggaggttctcttctggggagttcgggaaatgaagaaggtgcagctcctctctgtggatcggcctcaggctctcattgagtgcggaggacaaggtgtgaagtcctgcgtgatccagagctacaagaacaacccgaacttcagcatccaggcagacgctttcgaagtggaactgcctgagaacgagcttctgcacccgccactgagcatctgcgtggtggactggagagcttttgggaggagtacccttgtgggcacctacaccatcaactacttgaagcagtttttgtgtaaactcagagagccccttgcccccatcacacaggtggatggaacccagcctgggcacgatatttcagattcgctaacagccactgagtcctctggagcccacagctcctcccaggatcccccagcagatcacatttatgtggatgttgagccacctcccacagtggtgcccgactctgcccaggcccagccggccatcctggttgacgtccctgactcatccccgatgctggagcctgaacacacacctgtagcccaggagccaccaaaagatggaaaacctaaggatcccaggaagccttcccggaggtccactaagaggagaaagaggaccatagcagatgaatctgctgaaaacgtgattgactggtggtctaagtattatgcctccctgaagaaagcccagaaggcaaaggagagaaatcccaagggaaaaaaaggcaatacagaggcaaagccagatgaggtagtggtagatatagaagatgggccaaagaagaagaaagacaaaatgctcaagaagaaacccaaagatgatggaatccccaacctggccatcttgcagatatatgacggtgatctcgagagtgaattcaacaattttgaagactgggtgaaaacttttgagctcttcagaggcaagtctacggaagatgaccatggtcttgatggagaccgagtcataggaaaatttaagggctccttctgcatctacaaaagcccccaggattctagctctgaggacagcgggcagctgagaatccagcaagggattccgcccaatcaccctgtcacagtgctgatcagagtatacattgtcgcggcatttaatcttagtccagctgatccagatggcaaatcagatccctacattgtgatcaagcttggcaagacagaaatcaaagaccgggataaatacatccctaaacaactgaacccagtatttggaaggtcatttgagatccaagccacattcccaaaagagtccctgctctccatcctgatctatgaccatgacatgattggcacagatgaccttattggtgagaccaagatcgacctggagaaccgcttctacagcaaacaccgagccatctgtggcttgcagagccagtatgagatagaaggatacaatgcctggagagacacgtccaaacccaccgaaatcctcactaagctctgcaaagacaacaagctggatggaccctactttcaccctgggaaaatacagataggaaaccaagtcttttctggaaaaactatcttcactgaagaggacactgatgagacagtggagtcttatgaacacctggccctcaaggttttacactcttgggaggatatcccggaagtcgggtgtaggctggttcctgaacacatagaaactcggccactgtaccacaaggataagccaggaatggagcagggccgcctgcagatgtgggtggacatgtttcccaaggatatgcctcaacctggacctcctgttgacatctctccaaggcgacccaaaggatacgaattgagagtgaccatctggaacactgaagatgtcattttagaggatgagaatatcttcacaggccaaaaatcaagtgatatttatgtgaaagggtggttaaagggcttggaggatgacaagcaggagacagatgtgcattacaactccctgactggagagggcaacttcaactggcgcttcctgtttccctttcagtatctcccagctgagaagcaaatggtcattaccaagagggagaacatcttctctttagagaagatggagtgtaagactcctgctgtgttggtgctgcaggtttgggattttgaaaggctgtcctcagatgacttcctgggcaccctggaaatgaacctcaacagtttccctcgagcagctaagtctgccaaagcctgtgatcttgccaagtttgaaaatgcaagtgaggagaccaagatctctatattccagcaaaaacgtgtgcgtggctggtggcctttttctaaaagcaaagaactcacaggcaaggttgaagctgagttccacctagttacagcagaagaagctgagaaaaatcctgttggaaaagcccgaaaggagccagagcccctggccaagcccaaccgcccagacacctccttttcgtggttcatgagcccctttaagtgcctgtactacctcatctggaagaattacaaaaagtacatcatcattgctttcattctcatcatcctcatcatcttcctcgtccttttcatctacaccttgccaggagccatcagccgaaggatcgttgtgggctcatagaggatcatggaggacccagatcctcgccatatactaatcctctcttccttatctgggagcatctaagaacatgtcccatgcatggcactgtgctgagtgctaaggggacagatcaacccttcttggaagagatggaaaagaaacatttcctccctgctccaacccctgcctccaagtttcaaacttgtaaggcatgttttatcccttgggcagcatgaaataaggcactttcacctcatggtaatcaacaatgacctcaaattgacttaga

SEQ ID NO: 2349 - DNA, 499 bp, Homo sapiens
ggggtcgggagttggagaccagcctgaccaacatggagaaaccccaactctactaaaaatacaaaattagccgggcatggtggcgcatgcctgtaatcccagctactcgggaggctgaggcaggagaatcgcttgaacccgggaggcggaggttgtggtgagctgagatcacgccattgcactccagcctgggcaacaagagcaaaactctctctcaaaaaaaaaaaaagaaaagaaaaaagaaagtaaataggggatttgaacagaaacaggtttgcaggtagaaaaaaacgtctcaaccactgaggtaaatggaagagctggagaccagtttattccagacacggaaagcacatagaatagaacaaatggtggcaagatggcttcggcgctcccgggacagctcggcccgggctaaagttgctgcagctgatgggcccgccaggaacccaactcagaccctcatccctgtgcgacacacagtaaagatagacaaaga

SEQ ID NO: 2350 - DNA, 4971 bp, Homo sapiens
ggccgcgaccgtgcccgccgctgggcggggccgcccttctccgagagcgtcagcccgctaggtccttgtccgcgcgggcggcacctcctctgcaggtaaatggaagagctggagaccagtttattccagacacggaaagcacatagaatagaacaaatggtggcaagatggcttcggcgctcccgggacagctcggcccgggctaaagttgctgcagctgatgggcccgccaggaacccaactcagaccctcatccctgtgcgacacacagtaaagatagacaaagacaccctcctccaggactatggatttcacatttctgagagccttccccttacagtggtggctgtcacagcaggaggctctgctcacggcaagcttttccctggtgatcagatcctccaaatgaacaatgagcctgctgaagacctttcctgggaacgagcagtcgatattctcagggaagcagaagattctctttcaatcacagttgttcgctgcacgtcgggagtccctaaatcgtccttcctgaccgaggagaagagagccagactgaagaccaaccccgtgaaggtgcactttgctgaagaagtgctcatcagtggacacagccagggtaattctctgctgtgtatgcccaacgtgctcaagctatacttggagaatggacagaccaaagctttcaagtttgaggcaaacacaaccgtgaaggacatcatcctcaccgtgaaggagaagctgtccatccgaagtatcgagtactttgcactggccctggaagagcagtacagcatctcccggctgcacctgctgcacgaagaggaactcatccagcaggtggtagaaagggaggagtcacatgactaccgctgcctcttcagggtctgttttgttcccaaggaccccctggacctcctgaaagaagaccccgtggcctttgaatacctctatctgcagagctgcagcgatgtgctccaggagcgctttgctgtagaaatgaaatgtagctctgcactccgactcgcggctctgcacatccaggaacggatctacgcctgtgcccagccacagaagatctctttaaagtatatagagaaagactggggaatagagaactttatatctccaactttactccgaaacatgaaaggcaaagacatcaagaaagccattagcttccacatgaagaggaaccagaatttgctggaaccccgacagaagcaacttatttctgctgcccagctacgtttaaattatctacagatcctcggagaactcaagacatatggtggaagaatctttaatgctactttaatgttacaggatagagaatcctacattgcccttctagttggagccaagtatgggattagccaggttatcaatagcaaactcaacatcatgtccacattggcagagtttgcaaacatcagccgtgtagagctaacggaagagtctgagaaagtgagcgtcgtcaaagtgtatcttcaggacgtcaaggttctgactttgctgctggaatccaacagtgcaaaagacctagcctgcctgattgctgggtactacaggctgttggttgacccagttacctccattttcctctggcctggaaacaaacaacaagcgcaccgggtatctgcagaagaaggctatgaatccagggcctgcagtgactcagaggagtcctctgaggtggactgcgtactcgaacctctctctgacaggcgcctggtgaaactggcaccctgcagatcactcataaaggaggagcagcctcctgggaacagccccacacctgaggtggctaggaggggccccagcacctgcggggccagcagcacgacagacagtgccgagtccgaggcgtccgactcagccaacactgagagccgcggctacaggaccagtggctcgagtgagtccatggacgctctggaagaggatgacttagacacctgctcctccagcaggtccaccttcttccactttggctcgccaggcctcgcagagagcattgactctgacagccaggaggagagaagcgggattgaaaccagtggcttcctctgtctcctggacctggcccagagagccaacccccagtgccagaagacagagttttccgagagtgctgctttggagacatttggctgggcaccagaactgagcacagtcaggctggaccccaggctgtatgaaggcagccacgctgactactacagcctgtgttccagtgtctccccggccagctacctgagtgacagttccgagagtacagcttcccggcaagggggagccccgccagcctggggtcagcagggctggactgaggcccagcccagttccatgctggaacccctggccctgcacccaccactggcctttgaggatggcagctcagatgaggaatactatgacgcggctgataagctcactcccccaggccccccgtcagggcccagagatgtttctactgcagaacccagtgccacaagcttgcagaataaggccagcacttctagccctgagaacagcctgccttgtgggccagatggaagacagccaagcaggaggggaggggtgaagaaatatgccaagaccctgaggaaaagaaggtctttcctacagaccgactacacctctcaggtctcatttcccctggtgccatcagcctccctggagagtgtagacgacgtgtgctactatgacagggagccctacctggcccttggtgcaccctccccaactgtgtcctctctgcaggacatgcagggtgagcctggccttctggagaccaaggccttggggctgctggctcctctgagggagaccaagagcacaaacccagcctccagggtcatggagatggagcccgagaccatggaaaccaaatcagtcatcgactctcgagtgtcttctatttctgccattcgcttccggattgaccccaacaataaagagaattctggtgttgtccctgctgccagctcctcagcaagcactcctcactgttctaacccaggttcatctggcccagatactgctcaggcaaggccttcccaaatcttacctctatctcaagacctggatgggattgcccccaaagaaccaaccatagagcatggagacagctccttctccctctccagtggtgaccctaacccagacagagcctgcctggccagcaacccaggactaaataatgtctctcaaggagacacactagagctccagttggagccccatgtccagttggaaatgggattggaatctttttgtacaaatcatatacaagaaactgcccccaaatacacagagcctttgttgtctcctagagatgagcctagaagtgatgaatgtggaataaatccaggagagaagatagcttctatccctacaaaggaagagccacaaggacaactatctctggaaagagacagagaagttacaaacaaaaatggcaccaacgtatttcaggaggagtctaggaaggattcaggtgactccccgggtgatgtgtcaaataatgtttcacagactcttgatattagctctccagctggtaaaatagtaacctccctttctttagatgctcctgtaacagggaccgagcagatcccaccacatccccctagagaccctcaaggacagagcagagaacccccagggcaaggctgccaggctcaagaacaaaaactattcgtagagttggatttagaccctgatttctttcttgggaagcagacagtttcaccagccgtccctccagaggggatcaaggcagaggcacctaaccatgtgacagggcaagatatagcccctagggacagccctgagtgggtctgttttaatcctgagccttccctgccagaaccactaccatgtccacaagaggatcctcacttagaaacttcaaaccattgcttactctcagaaggcaaaagtgacagctctagcatctgcctttctgctgagaagtcttttctgtgctttgccccagaaagccatcctgaagtctctgccagtctcagggtggccacatctttgggttttgcaggcatgaatgagatggtggctcccaggatagggatggaccagtgcagctgtcagttctcctatgccacatgcttccgtggcccgcagcctgagacagaggaagaagacagggacttggaagcacaccccatggcccccctcacctcaccgccctctgcgggaagcccggtggttctgccctggaggcctgcccgagcccacagctgcaccaccgcacccctgtcgaggaaaagccacatctggccagagtactgctccagggcactgagacagctgaaagccacccctgccagcacccctgagggcttcatccaactcatggagagcttgctggagctacaagacattttagaaacttcctggggggttggaaacaaacatcccccagagaagtgcacctggcactttaccgaaagccggagccgcctctgcatgggctcccagaagctcctgtcgagctgtcggcatgtgatcagaatggaccagtcccccgaagagatgcagggggccgtgcgtgacaccttccagcacctggtccagctggccggcctgtgctttcagttcacagactgtagccgctgctccgcccggcacagggaggcagcggggaacctgagggatgtggtgtacacctaccatcagtttatagaggctgctaaatcgacctgcgagagaggctaccacgacctgagtgtgaaactcctggcccgtcagtgcacggccctcacggccgccgtgttctgtttgacccagaagttccgggcatccacggccctgtaaacaggtcaacggcccaagggcctcctgccctgtcctgccttggacacttccctgagaagccccttccactctcccacccaccctcttcaaatgtttactatatagagtattcaaataaactgctgcttaatcttg

SEQ ID NO: 2351 - DNA, 2805 bp, Homo sapiens
atcctttgaattgtctctttaaaatatgagatggctgaagtgggtgtaagtaggtggtttataatatgttctagatgccaagatattcatggtagcagagctgatgttcagaacgtggcccagagtttcatcttggtacttttacacatggaaacattctagaggctggtctaaaggactgtccacaccaagggaacataggctgttaggctggaaaatagtgtatcaggatttcatccaggaaggtcacagcctgttggtctagaagatcatgtaagatgctattcagcaagtgtcacaagttggcctgatacaatctagtccaaagtcttcaccatatactcataccaacctgtgatgactctctttacttctttgggaaaagaaggtaccttccaaaagataagagcgaagtggagccaaggggagtccctaaatcgtccttcctgaccgaggagaagagagccagactgaagaccaaccccgtgaaggtgcactttgctgaagaagtgctcatcagtggacacagccagggtaattctctgctgtgtatgcccaacgtgctcaagctatacttggagaatggacagaccaaagctttcaagtttgaggcaaacacaaccgtgaaggacatcatcctcaccgtgaaggagaagctgtccatccgaagtatcgagtactttgcactggccctggaagagcagtacagcatctcccggctgcacctgctgcacgaagaggaactcatccagcaggtggtagaaagggaggagtcacatgactaccgctgcctcttcagggtctgttttgttcccaaggaccccctggacctcctgaaagaagaccccgtggcctttgaatacctctatctgcagagctgcagcgatgtgctccaggagcgctttgctgtagaaatgaaatgtagctctgcactccgactcgcggctctgcacatccaggaacggatctacgcctgtgcccagccacagaagatctctttaaagtatatagagaaagactggggaatagagaactttatatctccaactttactccgaaacatgaaaggcaaagacatcaagaaagccattagcttccacatgaagaggaaccagaatttgctggaaccccgacagaagcaacttatttctgctgcccagctacgtttaaattatctacagatcctcggagaactcaagacatatggtggaagaatctttaatgctactttaatgttacaggatagagaatcctacattgcccttctagttggagccaagtatgggattagccaggttatcaatagcaaactcaacatcatgtccacattggcagagtttgcaaacatcagccgtgtagagctaacggaagagtctgagaaagtgagcgtcgtcaaagtgtatcttcaggacgtcaaggttctgactttgctgctggaatccaacagtgcaaaagacctagcctgcctgattgctgggtactacaggctgttggttgacccagttacctccattttcctctggcctggaaacaaacaacaagcgcaccgggtatctgcagaagaaggctatgaatccagggcctgcagtgactcagaggagtcctctgaggtggactgcgtactcgaacctctctctgacaggcgcctggtgaaactggcaccctgcagatcactcataaaggaggagcagcctcctgggaacagccccacacctgaggtggctaggaggggccccagcacctgcggggccagcagcacgacagacagtgccgagtccgaggcgtccgactcagccaacactgagagccgcggctacaggaccagtggctcgagtgagtccatggacgctctggaagaggatgacttagacacctgctcctccagcaggtccaccttcttccactttggctcgccaggcctcgcagagagcattgactctgacagccaggaggagagaagcgggattgaaaccagtggcttcctctgtctcctggacctggcccagagagccaacccccagtgccagaagacagagttttccgagagtgctgctttggagacatttggctgggcaccagaactgagcacagtcaggctggaccccaggctgtatgaaggcagccacgctgactactacagcctgtgttccagtgtctccccggccagctacctgagtgacagttccgagagtacagcttcccggcaagggggagccccgccagcctggggtcagcagggctggactgaggcccagcccagttccatgctggaacccctggccctgcacccaccactggcctttgaggatggcagctcagatgaggaatactatgacgcggctgataagctcactcccccaggccccccgtcaggtgagccgtcccttgcaggtctgcagacacggcaggcagctcctgagtgcctcccggggatcaaggcctggggccaagcttgagaggaaggcacatgagtgaaacagggtccctgtacacttctgaggaggtagatacagattccatggaccaaattttaggcatcgtggcaggcctgcaagggaggttcagacaactgtggcaagcagatgggagggattcatccaacagtgggaatcagggaaggcttcccagaagagggggcaaatgggctgggccctgtgggagggacagaatttacaaaaaaggaaagggcttgacaggagtgcccggcagagcgaagtggctatgtcatcactgatcctgaggctgcattaaaggaggccttgaagcaagaagaaccagacagacaggccgtctgtggccctgcaa

SEQ ID NO: 2352 - DNA, 5465 bp, Homo sapiens
gaacacaactgggcagaactagcaggagaccaagtattatgtggcacagaataaactctacaactataaaatggatgcatcatgagaccttgggtgtcatcttctgtgttgcccttggcacagaggaagccagtttgccaatcaaggacctctagggtttcctctctcgactggctcaagtggttgaggtcttgaggatgagaatgccatctgcaggactcctgtgcctgtcgtgctgaaaggagagaagccagacatgttgacaggcatagctgcagctgcccagtatccgcagatgaggagggtcatgctcctgtgaggagggggcccgtgccacagagataccacccaactttgcccacatggcctggcagtcggttttacttgggcttatcgatgagctatgggaaggtcatttgatattcacattcttgtggccgcaatgttgggaatgtggccttttatctttaaaaatagctgtgtgctgggaggcccgggagcagtgtcctgggatggaggggagctgccagcagggggaagaggtgtggatttctttccgaggaagagtcccttcagctctgtgccactggtaaatggaagagctggagaccagtttattccagacacggaaagcacatagaatagaacaaatggtggcaagatggcttcggcgctcccgggacagctcggcccgggctaaagttgctgcagctgatgggcccgccaggaacccaactcagaccctcatccctgtgcgacacacagtaaagatagacaaagacaccctcctccaggactatggatttcacatttctgagagccttccccttacagtggtggctgtcacagcaggaggctctgctcacggcaagcttttccctggtgatcagatcctccaaatgaacaatgagcctgctgaagacctttcctgggaacgagcagtcgatattctcagggaagcagaagattctctttcaatcacagttgttcgctgcacgtcgggagtccctaaatcgtccttcctgaccgaggagaagagagccagactgaagaccaaccccgtgaaggtgcactttgctgaagaagtgctcatcagtggacacagccagggtaattctctgctgtgtatgcccaacgtgctcaagctatacttggagaatggacagaccaaagctttcaagtttgaggcaaacacaaccgtgaaggacatcatcctcaccgtgaaggagaagctgtccatccgaagtatcgagtactttgcactggccctggaagagcagtacagcatctcccggctgcacctgctgcacgaagaggaactcatccagcaggtggtagaaagggaggagtcacatgactaccgctgcctcttcagggtctgttttgttcccaaggaccccctggacctcctgaaagaagaccccgtggcctttgaatacctctatctgcagagctgcagcgatgtgctccaggagcgctttgctgtagaaatgaaatgtagctctgcactccgactcgcggctctgcacatccaggaacggatctacgcctgtgcccagccacagaagatctctttaaagtatatagagaaagactggggaatagagaactttatatctccaactttactccgaaacatgaaaggcaaagacatcaagaaagccattagcttccacatgaagaggaaccagaatttgctggaaccccgacagaagcaacttatttctgctgcccagctacgtttaaattatctacagatcctcggagaactcaagacatatggtggaagaatctttaatgctactttaatgttacaggatagagaatcctacattgcccttctagttggagccaagtatgggattagccaggttatcaatagcaaactcaacatcatgtccacattggcagagtttgcaaacatcagccgtgtagagctaacggaagagtctgagaaagtgagcgtcgtcaaagtgtatcttcaggacgtcaaggttctgactttgctgctggaatccaacagtgcaaaagacctagcctgcctgattgctgggtactacaggctgttggttgacccagttacctccattttcctctggcctggaaacaaacaacaagcgcaccgggtatctgcagaagaaggctatgaatccagggcctgcagtgactcagaggagtcctctgaggtggactgcgtactcgaacctctctctgacaggcgcctggtgaaactggcaccctgcagatcactcataaaggaggagcagcctcctgggaacagccccacacctgaggtggctaggaggggccccagcacctgcggggccagcagcacgacagacagtgccgagtccgaggcgtccgactcagccaacactgagagccgcggctacaggaccagtggctcgagtgagtccatggacgctctggaagaggatgacttagacacctgctcctccagcaggtccaccttcttccactttggctcgccaggcctcgcagagagcattgactctgacagccaggaggagagaagcgggattgaaaccagtggcttcctctgtctcctggacctggcccagagagccaacccccagtgccagaagacagagttttccgagagtgctgctttggagacatttggctgggcaccagaactgagcacagtcaggctggaccccaggctgtatgaaggcagccacgctgactactacagcctgtgttccagtgtctccccggccagctacctgagtgacagttccgagagtacagcttcccggcaagggggagccccgccagcctggggtcagcagggctggactgaggcccagcccagttccatgctggaacccctggccctgcacccaccactggcctttgaggatggcagctcagatgaggaatactatgacgcggctgataagctcactcccccaggccccccgtcagggcccagagatgtttctactgcagaacccagtgccacaagcttgcagaataaggccagcacttctagccctgagaacagcctgccttgtgggccagatggaagacagccaagcaggaggggaggggtgaagaaatatgccaagaccctgaggaaaagaaggtctttcctacagaccgactacacctctcaggtctcatttcccctggtgccatcagcctccctggagagtgtagacgacgtgtgctactatgacagggagccctacctggcccttggtgcaccctccccaactgtgtcctctctgcaggacatgcagggtgagcctggccttctggagaccaaggccttggggctgctggctcctctgagggagaccaagagcacaaacccagcctccagggtcatggagatggagcccgagaccatggaaaccaaatcagtcatcgactctcgagtgtcttctatttctgccattcgcttccggattgaccccaacaataaagagaattctggtgttgtccctgctgccagctcctcagcaagcactcctcactgttctaacccaggttcatctggcccagatactgctcaggcaaggccttcccaaatcttacctctatctcaagacctggatgggattgcccccaaagaaccaaccatagagcatggagacagctccttctccctctccagtggtgaccctaacccagacagagcctgcctggccagcaacccaggactaaataatgtctctcaaggagacacactagagctccagttggagccccatgtccagttggaaatgggattggaatctttttgtacaaatcatatacaagaaactgcccccaaatacacagagcctttgttgtctcctagagatgagcctagaagtgatgaatgtggaataaatccaggagagaagatagcttctatccctacaaaggaagagccacaaggacaactatctctggaaagagacagagaagttacaaacaaaaatggcaccaacgtatttcaggaggagtctaggaaggattcaggtgactccccgggtgatgtgtcaaataatgtttcacagactcttgatattagctctccagctggtaaaatagtaacctccctttctttagatgctcctgtaacagggaccgagcagatcccaccacatccccctagagaccctcaaggacagagcagagaacccccagggcaaggctgccaggctcaagaacaaaaactattcgtagagttggatttagaccctgatttctttcttgggaagcagacagtttcaccagccgtccctccagaggggatcaaggcagaggcacctaaccatgtgacagggcaagatatagcccctagggacagccctgagtgggtctgttttaatcctgagccttccctgccagaaccactaccatgtccacaagaggatcctcacttagaaacttcaaaccattgcttactctcagaaggcaaaagtgacagctctagcatctgcctttctgctgagaagtcttttctgtgctttgccccagaaagccatcctgaagtctctgccagtctcagggtggccacatctttgggttttgcaggcatgaatgagatggtggctcccaggatagggatggaccagtgcagctgtcagttctcctatgccacatgcttccgtggcccgcagcctgagacagaggaagaagacagggacttggaagcacaccccatggcccccctcacctcaccgccctctgcgggaagcccggtggttctgccctggaggcctgcccgagcccacagctgcaccaccgcacccctgtcgaggaaaagccacatctggccagagtactgctccagggcactgagacagctgaaagccacccctgccagcacccctgagggcttcatccaactcatggagagcttgctggagctacaagacattttagaaacttcctggggggttggaaacaaacatcccccagagaagtgcacctggcactttaccgaaagccggagccgcctctgcatgggctcccagaagctcctgtcgagctgtcggcatgtgatcagaatggaccagtcccccgaagagatgcagggggccgtgcgtgacaccttccagcacctggtccagctggccggcctgtgctttcagttcacagactgtagccgctgctccgcccggcacagggaggcagcggggaacctgagggatgtggtgtacacctaccatcagtttatagaggctgctaaatcgacctgcgagagaggctaccacgacctgagtgtgaaactcctggcccgtcagtgcacggccctcacggccgccgtgttctgtttgacccagaagttccgggcatccacggccctgtaaacaggtcaacggcccaagggcctcctgccctgtcctgccttggacacttccctgagaagccccttccactctcccacccaccctcttcaaatgtttactatatagagtattcaaataaactgctgcttaatcttg

SEQ ID NO: 2353 - DNA, 2270 bp, Homo sapiens
gaattgtctctttaaaatatgagatggctgaagtgggtggagtccctaaatcgtccttcctgaccgaggagaagagagccagactgaagaccaaccccgtgaaggtgcactttgctgaagaagtgctcatcagtggacacagccagggtaattctctgctgtgtatgcccaacgtgctcaagctatacttggagaatggacagaccaaagctttcaagtttgaggcaaacacaaccgtgaaggacatcatcctcaccgtgaaggagaagctgtccatccgaagtatcgagtactttgcactggccctggaagagcagtacagcatctcccggctgcacctgctgcacgaagaggaactcatccagcaggtggtagaaagggaggagtcacatgactaccgctgcctcttcagggtctgttttgttcccaaggaccccctggacctcctgaaagaagaccccgtggcctttgaatacctctatctgcagagctgcagcgatgtgctccaggagcgctttgctgtagaaatgaaatgtagctctgcactccgactcgcggctctgcacatccaggaacggatctacgcctgtgcccagccacagaagatctctttaaagtatatagagaaagactggggaatagagaactttatatctccaactttactccgaaacatgaaaggcaaagacatcaagaaagccattagcttccacatgaagaggaaccagaatttgctggaaccccgacagaagcaacttatttctgctgcccagctacgtttaaattatctacagatcctcggagaactcaagacatatggtggaagaatctttaatgctactttaatgttacaggatagagaatcctacattgcccttctagttggagccaagtatgggattagccaggttatcaatagcaaactcaacatcatgtccacattggcagagtttgcaaacatcagccgtgtagagctaacggaagagtctgagaaagtgagcgtcgtcaaagtgtatcttcaggacgtcaaggttctgactttgctgctggaatccaacagtgcaaaagacctagcctgcctgattgctgggtactacaggctgttggttgacccagttacctccattttcctctggcctggaaacaaacaacaagcgcaccgggtatctgcagaagaaggctatgaatccagggcctgcagtgactcagaggagtcctctgaggtggactgcgtactcgaacctctctctgacaggcgcctggtgaaactggcaccctgcagatcactcataaaggaggagcagcctcctgggaacagccccacacctgaggtggctaggaggggccccagcacctgcggggccagcagcacgacagacagtgccgagtccgaggcgtccgactcagccaacactgagagccgcggctacaggaccagtggctcgagtgagtccatggacgctctggaagaggatgacttagacacctgctcctccagcaggtccaccttcttccactttggctcgccaggcctcgcagagagcattgactctgacagccaggaggagagaagcgggattgaaaccagtggcttcctctgtctcctggacctggcccagagagccaacccccagtgccagaagacagagttttccgagagtgctgctttggagacatttggctgggcaccagaactgagcacagtcaggctggaccccaggctgtatgaaggcagccacgctgactactacagcctgtgttccagtgtctccccggccagctacctgagtgacagttccgagagtacagcttcccggcaagggggagccccgccagcctggggtcagcagggctggactgaggcccagcccagttccatgctggaacccctggccctgcacccaccactggcctttgaggatggcagctcagatgaggaatactatgacgcggctgataagctcactcccccaggccccccgtcaggtgagccgtcccttgcaggtctgcagacacggcaggcagctcctgagtgcctcccggggatcaaggcctggggccaagcttgagaggaaggcacatgagtgaaacagggtccctgtacacttctgaggaggtagatacagattccatggaccaaattttaggcatcgtggcaggcctgcaagggaggttcagacaactgtggcaagcagatgggagggattcatccaacagtgggaatcagggaaggcttcccagaagagggggcaaatgggctgggccctgtg

SEQ ID NO: 2354 - DNA, 5011 bp, Homo sapiens
ggctgagggaaggaggaggataaggaggaggaacgaggccagcaggaggcaacggcagcgacggggccggggtgatggtgcaggtgcctggggtcggtgcggagctgccgggctgagggacgcctggtccagggtccgcagcgccgccgcgtcgctcccgggcgggcgggcgggaagatgctgagcaggttgatgagcggcagcagcaggagcctggagcgcgagtacagctgcaccgtgcggctgctggacgacagcgagtacacctgcaccatccagagagatgccaaaggccagtacctgtttgaccttctttgccaccatctgaacctacttgagaaagactattttggtatccgctttgtagacccagataagcagcggcattggctggaatttacaaagtctgtggtgaaacaattgagatcccagcctccattcaccatgtgcttccgtgtgaagttttatcctgcagaccctgctgctctgaaagaagaaataaccaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgagtggtcaaacaccagcaacatcagagctgaacttcttaagaaaagcacagacattggaaacatatggagtggatcctcacccatgtaaggacgtgtcaggaaatgctgcatttctggccttcactccttttgggtttgttgttcttcaaggaaacaagagggtccacttcattaaatggaatgaggtgaccaagctgaaatttgaaggaaagactttctatttatacgtaagtcagaaagaggaaaagaaaattattcttacatattttgctccaactcctgaagcgtgtaagcacctctggaaatgtggaatcgagaaccaagccttctacaagctggagaagtcaagccaagtccgcacagtgtccagcagcaatttattctttaaagggagccggttccgatacagtggccgagttgcaaaggaagtcatggaatcaagtgctaagatcaaacgggagccaccggaaatacacagagcagggatggttcccagccggagctgtccctccataacccatggcccaaggctgagcagcgtccccaggacccgcagaagagctgttcacatctccatcatggaaggcctagagtccttacgggacagtgcccattccacaccagtgcgttccacttcccatggggacaccttcctgcctcacgtgagaagcagccggacagatagcaatgagcgagtagctgtgattgcagacgaggcctacagccctgcagacagcgtgctgcccacccctgtggctgagcacagcctggagctgatgttgctttcccggcagatcaatggagccacctgcagcattgaggaggagaaggaatctgaagccagcaccccaactgctacagaggtggaggcccttgggggagagctgagggccctgtgtcaggggcacagcgggcccgaggaggaacaggtgaataagtttgttctaagtgtcctccgtttgctccttgtgaccatgggactcctctttgttttgctcctcctcctgatcatccttaccgagtctgaccttgacattgcctttttccgtgatatccgccagacccccgagtttgaacaattccactatcaatacttttgtcccctcaggcgatggtttgcctgcaaaatccgctcagtggtgagcctgctcattgacacctgagaaggcatgactcctcccaaaaactagccaggtggaccaaggaacccggctacccattcccagcaatgggacccatcgcggaaccatcggcacatataccaagtcctcctctcatgactcaaagtccactgcagcctaggagggtgtttcccagaagaagaaagggataggctcatgccctgtctaaacaaactgggaaaactcattttcttcagaagttatttcaagaaaggctcagcgactctgtttctcatctttccaatttgcaggataatttttggttttgaattttgatttttcatagatgtatattattttgaagtatcaaataaaaataatttattttactattactgattattgcagtagtatcacctagcagaggggacactagttgaaaactagagagctgctgtcctctgtattctgcaggagcttttcctgctggtgccactgggttccagtagactcatcactgcagcctcagcagggcaggccagggatctggacaatggggactgtttagttttttgtttgttttttttgccagccagaacttttaaaaaagtaaacatccatgtagaatgattaaatggaaagttgcttcttatgatggtctgagttggattttcttttccttttgttttttcaaatctgagcagagtgggcatctgaagggaccaccgctacagcaacagcagcatcaggggtggggtaagtctgtccccttagtctagagcctagtgggcatcaccatagttttgtataatgaaactagacttaacgtgattttttttttccgaagaacctcaagacttttatagtgctccaggggcgttaaacgaattcagtggtaccagagatagatagttctgtcagaaatgttggacaaagtgtagttaagagaaagcagagttaagttacctgagagactgttgagatttggatagcagtgcttattttatatacacccccttgacccaaagactatttcaatttatattttaacaacgaaatgttattttcttaacaattcatattttgtttttactttatggattaagaaaatagagcctgatgaactaaacgatgcaagaaagaaactgatcctgagaatgaaaagcttcagaaaatagaattccaagatcaacagccttagaagggaccaggaaaagaatcttttaaaatagatttctaagagatgcctacaaaacacagaatgtgaccgtggcagagaccaacacttagatgtagaaatgctgccccctagggtcatcctctgcataagttctaggaaagcatcaccatccttgcagagggaagtcctcgaagcacgcagcacaggcatatgaagggcgagtgtgggatcctaggcccaagctcttcaactctaaaaccaatcacacacaagatcctgttttcatctcagggagagatttctaagtcatctggggcttgagggcttatttaagggtggtcaatggacatattcctggacccacacaaaagtagagcagctgctgataccctaattggacagccccaaacgcagaacagaacaagtcacttgtagacttgacctcccctattttgtcccccgagatggtagaaccatgtccatgtttacaatatgacaactgtggaataattggggttcttagggagagatttgcataattttaaagacatcctttcatctggaccagaggtcaatcaacttatgtcaagtgctacacagtaaatattttggtttagcacgccatactgtgtcacaactgctcaattctgccatcacagcacaaaaacagccacagataatttgtaaatgaaggaacatggctgtgttccaataaaactttatgaaaacagtgagctgaatttagcctacaggccataatacgccaatcctgctctagacaataaaactgatccttaccagtatgttagcagaagagggtcagtcagctctgtttccatgcctgacatgtatcaaagatctgggacctcttcccagtggaggcactagggttgcttgtttaaagggtgcttgaacaactaaccagcaaagagatgtctgatgccaaatgggcaagatcaaatactggaatgctaaaacacagctggaatctaagaagggaagagggcttctctgaccattttcataccagcaacaatttaggcagaattataaacatctatttatcgagtgacaatacaaaccgaaggagatcctagtagagattaggggtcagttaaaatcaactagccactgccacttgtcatctacatagcaaaggctttatttagcacaggactaacgtgaaaagtagacccagagatgaaaaggctgtcaggagacagggggctggtgtccacctggtatctactgtcttatgcaacatagaagattaccttttagtgtagtgctcctacctcagtttgtagaatctggtgtttctatgcagtgagtgatagcctcaactctgacctttcatattcacattagagacagatgcagtattccatatcctagtatgttccttgtgtctagagttctaacagtacagtagtctatgccatttctaacagctaaattttgctctgtaaacagaaactttagggttgtttttttccagggctcatcccagaaaatatggatagaaaagtttccttcagtttgcttttcaaatagtgcttgaataataaacctcctttgattggtgactagtcttttttggtatatctccacctttaaaaattgttcaagtttttaacctggttatactgtgttctaacatgtctctcattttctctcaaaattagtttatctcattgtagaaaaagcaatggttttcatagcttcatctatcaggaaataaaactcttactaaagaatagcatactgcatctttaagcagtagagggtaaactacctgcaaatgtgaatttcttagatacatttaaaaatatatagttgttaaccttctgtgtgccaaaaactcttaagttacattttccttcaaagcaatgtacttttttctacatatgcagtatgtagttagcataaaatcattggtgccatgaagattatttttaaacttaaataaatatttaaatatca

SEQ ID NO: 2355 - DNA, 2319 bp, Homo sapiens
agaactgaacgcgcagcccatgcggagtggcctattgaaggaagcccagtcctctgggttttagagatttaggccccctcccgccttttgatccccaaattttattgtgttgggcggttctaggggacgtgaggtaaagatttagcaacaagtcccagcgatttggggcttggaagtggccaggaagaatcggcgacttaggaaaaacgccaacaatacggagtttcagaatcatctgtaagaggcctggaatccagaggcacccaagggaattagcaacaagaaatacataagagatgccaaaggccagtacctgtttgaccttctttgccaccatctgaacctacttgagaaagactattttggtatccgctttgtagacccagataagcagcggcattggctggaatttacaaagtctgtggtgaaacaattgagatcccagcctccattcaccatgtgcttccgtgtgaagttttatcctgcagaccctgctgctctgaaagaagaaataaccaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgagtggtcaaacaccagcaacatcagagctgaacttcttaagaaaagcacagacattggaaacatatggagtggatcctcacccatgtaaggacgtgtcaggaaatgctgcatttctggccttcactccttttgggtttgttgttcttcaaggaaacaagagggtccacttcattaaatggaatgaggtgaccaagctgaaatttgaaggaaagactttctatttatacgaaaagaaaattattcttacatattttgctccaactcctgaagcgtgtaagcacctctggaaatgtggaatcgagaaccaagccttctacaagctggagaagtcaagccaagtccgcacagtgtccagcagcaatttattctttaaagggagccggttccgatacagtggccgagttgcaaaggaagtcatggaatcaagtgctaagatcaaacgggagccaccggaaatacacagagcagggatggttcccagccggagctgtccctccataacccatggcccaaggctgagcagcgtccccaggacccgcagaagagctgttcacatctccatcatggaaggcctagagtccttacgggacagtgcccattccacaccagtgcgttccacttcccatggggacaccttcctgcctcacgtgagaagcagccggacagatagcaatgagcgagtagctgtgattgcagacgaggcctacagccctgcagacagcgtgctgcccacccctgtggctgagcacagcctggagctgatgttgctttcccggcagatcaatggagccacctgcagcattgaggaggagaaggaatctgaagccagcaccccaactgctacagaggtggaggcccttgggggagagctgagggccctgtgtcaggggcacagcgggcccgaggaggaacaggcgatggtttgcctgcaaaatccgctcagtggtgagcctgctcattgacacctgagaaggcatgactcctcccaaaaactagccaggtggaccaaggaacccggctacccattcccagcaatgggacccatcgcggaaccatcggcacatataccaagtcctcctctcatgactcaaagtccactgcagcctaggagggtgtttcccagaagaagaaagggataggctcatgccctgtctaaacaaactgggaaaactcattttcttcagaagttatttcaagaaaggctcagcgactctgtttctcatctttccaatttgcaggataatttttggttttgaattttgatttttcatagatgtatattattttgaagtatcaaataaaaataatttattttactattactgattattgcagtagtatcacctagcagaggggacactagttgaaaactagagagctgctgtcctctgtattctgcaggagcttttcctgctggtgccactgggttccagtagactcatcactgcagcctcagcagggcaggccagggatctggacaatggggactgtttagttttttgtttgttttttttgccagccagaacttttaaaaaagtaaacatccatgtagaatgattaaatggaaagttgcttctta

SEQ ID NO: 2356 - DNA, 2972 bp, Homo sapiens
agaggggtgaccagagagcccaacgcctggtgctcaagactttctccgagctatgaaacccacgtagtcgaacaccgtgatgcttctcctgcagggcgtgtgatgaggaggcgagcttggctttggagtgctgggaacctgaggaattgccaaggacccagagcccagccctgaccaccagagtgcccaaaacacaatgaacaaattgaattttcataacaacagagtcatgcaagaccgccgcagtgtgtgcattttccttcccaacgatgaatctctgaacatcatcataaatgttaagattctgtgtcaccagttgctggtccaggtttgtgacctgctcaggctaaaggactgccacctctttggactcagtgttatacaaaataatgaacatgtgtatatggagttgtcacaaaagctttacaaatattgtccaaaagaatggaagaaagaggccagcaaggtacgacaatacgaagtcacttggggtatcgaccaatttgggcctcctatgatcatccacttccgtgtgcagtactatgtggaaaatggcagattgatcagtgacagagcagcaagatactattattactggcacctgagaaaacaagttcttcattctcagtgtgtgctccgagaggaggcctacttcctgctggcagcctttgccctgcaggctgatcttgggaacttcaaaaggaataagcactatggaaaatacttcgagccagaggcttacttcccatcttgggttgtttccaagagggggaaggactacatcctgaagcacattccaaacatgcacaaagatcagtttgcactaacagcttccgaagctcatcttaaatatatcaaagaggctgtccgactggatgacgtcgctgttcattactacagattgtataaggataaaagggaaattgaagcatcgctgactcttggattgaccatgaggggaatacagatttttcagaatttagatgaagagaaacaattactttatgatttcccctggacaaatgttggaaaattggtgtttgtgggtaagaaatttgagattttgccagatggcttgccttctgcccggaagctcatatactacacggggtgccccatgcgctccagacacctcctgcaacttctgagcaacagccaccgcctctatatgaatctgcagcctgtcctgcgccatatccggaagctggaggaaaacgaagagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaacgttggtgcttggtgatgctttatttgtttaattatcaagaacaaattatggcaatgctagtttctgcttaaccaaaatactctgtgtatatattatacatatataaata

SEQ ID NO: 2357 - DNA, 4768 bp, Homo sapiens
cttgaaggaagggtgttgggtgaactaacactattttctcctgccctttcccccaatctcaatccctttctctccaaacattcttccttgagcaccccactctggcactcaaaaagccatgggaatgggaaagaagtggctggaagtaaacagcctgcttactcacagcaactgaaaattttgtttcgacgattctggttccaggggcaggagctgaagattaatgcctggagtctgccccattctgagagcagcagcctggctcctggtggctccagcagcagccttcatatctgtttttttcttatgaagcttcttctggttggaaacttgtcaaatttcatcagctatgaaacccacgtagtcgaacaccgtgatgcttctcctgcagggcgtgtgatgaggaggcgagcttggctttggagtgctgggaacctgaggaattgccaaggacccagagcccagccctgaccaccagagtgcccaaaacacaatgaacaaattgaattttcataacaacagagtcatgcaagaccgccgcagtgtgtgcattttccttcccaacgatgaatctctgaacatcatcataaatgttaagattctgtgtcaccagttgctggtccaggtttgtgacctgctcaggctaaaggactgccacctctttggactcagtgttatacaaaataatgaacatgtgtatatggagttgtcacaaaagctttacaaatattgtccaaaagaatggaagaaagaggccagcaagggtatcgaccaatttgggcctcctatgatcatccacttccgtgtgcagtactatgtggaaaatggcagattgatcagtgacagagcagcaagatactattattactggcacctgagaaaacaagttcttcattctcagtgtgtgctccgagaggaggcctacttcctgctggcagcctttgccctgcaggctgatcttgggaacttcaaaaggaataagcactatggaaaatacttcgagccagaggcttacttcccatcttgggttgtttccaagagggggaaggactacatcctgaagcacattccaaacatgcacaaagatcagtttgcactaacagcttccgaagctcatcttaaatatatcaaagaggctgtccgactggatgacgtcgctgttcattactacagattgtataaggataaaagggaaattgaagcatcgctgactcttggattgaccatgaggggaatacagatttttcagaatttagatgaagagaaacaattactttatgatttcccctggacaaatgttggaaaattggtgtttgtgggtaagaaatttgagattttgccagatggcttgccttctgcccggaagctcatatactacacggggtgccccatgcgctccagacacctcctgcaacttctgagcaacagccaccgcctctatatgaatctgcagcctgtcctgcgccatatccggaagctggaggaaaacgaagagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaacgttggtgcttggtgatgctttatttgtttaattatcaagaacaaattatggcaatgctagtttctgcttaaccaaaatactctgtgtatatattatacatatataaatacatgggattgtgtatgtctatatgtgtttaaagcttactatgtcttcattttggcttccatgactatcttttatacatggaattccttaagattgagaatatgtcactgagtgaatgatacctgcagacagtcagttgatatatgtagagttcagaatgactgttttctcatgtgcctttggccatgattctcaacactgattgtataacagaattttggggggagcttttaaaaaataatgactgagtctcccaccagaccgattacatcattctcttgtggcgggacccaagtagaattgccttttcttttaaagttctccagatggagctaatatgcaacaaagttgaaaaccactgatcctgggggtgtcttgttaattttgaagtaaaagtgtacagaagacgtagtgtatgagaaagggccatttttaagacagttacctgttgtgctgctgttacaatatataatgaaaccaagtcaggggagtgaatttatcaatcttttgatgtaaagtaaaaacgtagttcacacttcaggagagaacttcatagcacaatgtctttctataagatatttttaatgatttagtattttacaacatttgtttaccatattttgatataccatttttttctatctgcccagttttattaaaaaaactatatattattttctaaagaaacaatcatatttttatacaaaattatgttttcaggtaacgaaatagatgtagggtacagtggaacataagcagtgttacccctggctgggagtcagtattatacaacaaatggtgagctggaacatgccctgtctgtgctgtccctcctgtgctgggtcgcggatgtgtaggcaacattgccttatcacgctaggttcacctgacactttaaaaggaaaaaaagttccatagagttctgtggtcacaaaattgttttgcttttatcaaatactttaatagaaccaaagttgcagatattggaatgtatggaagtatctcagtctctgcataagaggattaaagtatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgtttttaaaaataaaaaggaaaggaaatatataaa

SEQ ID NO: 2358 - DNA, 4828 bp, Homo sapiens
ggggcggggcggacgcggagcgcccctctggctggcggggccaaggggctgagaggagtggggcaggctcggcgccggtaggaagagtcagaggggtgaccagagagcccaacgcctggtgctcaagactttctccgagctatgaaacccacgtagtcgaacaccgtgatgcttctcctgcagggcgtgtgatgaggaggcgagcttggctttggagtgctgggaacctgaggaattgccaaggacccagagcccagccctgaccaccagagtgcccaaaacacaatgaacaaattgaattttcataacaacagagtcatgcaagaccgccgcagtgtgtgcattttccttcccaacgatgaatctctgaacatcatcataaatgttaagattctgtgtcaccagttgctggtccaggtttgtgacctgctcaggctaaaggactgccacctctttggactcagtgttatacaaaataatgaacatgtgtatatggagttgtcacaaaagctttacaaatattgtccaaaagaatggaagaaagaggccagcaagggtatcgaccaatttgggcctcctatgatcatccacttccgtgtgcagtactatgtggaaaatggcagattgatcagtgacagagcagcaagatactattattactggcacctgagaaaacaagttcttcattctcagtgtgtgctccgagaggaggcctacttcctgctggcagcctttgccctgcaggctgatcttgggaacttcaaaaggaataagcactatggaaaatacttcgagccagaggcttacttcccatcttgggttgtttccaagagggggaaggactacatcctgaagcacattccaaacatgcacaaagatcagtttgcactaacagcttccgaagctcatcttaaatatatcaaagaggctgtccgactggatgacgtcgctgttcattactacagattgtataaggataaaagggaaattgaagcatcgctgactcttggattgaccatgaggggaatacagatttttcagaatttagatgaagagaaacaattactttatgatttcccctggacaaatgttggaaaattggtgtttgtgggtaagaaatttgagattttgccagatggcttgccttctgcccggaagctcatatactacacggggtgccccatgcgctccagacacctcctgcaacttctgagcaacagccaccgcctctatatgaatctgcagcctgtcctgcgccatatccggaagctggaggaaaacgaagagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaacgttggtgcttggtgatgctttatttgtttaattatcaagaacaaattatggcaatgctagtttctgcttaaccaaaatactctgtgtatatattatacatatataaatacatgggattgtgtatgtctatatgtgtttaaagcttactatgtcttcattttggcttccatgactatcttttatacatggaattccttaagattgagaatatgtcactgagtgaatgatacctgcagacagtcagttgatatatgtagagttcagaatgactgttttctcatgtgcctttggccatgattctcaacactgattgtataacagaattttggggggagcttttaaaaaataatgactgagtctcccaccagaccgattacatcattctcttgtggcgggacccaagtagaattgccttttcttttaaagttctccagatggagctaatatgcaacaaagttgaaaaccactgatcctgggggtgtcttgttaattttgaagtaaaagtgtacagaagacgtagtgtatgagaaagggccatttttaagacagttacctgttgtgctgctgttacaatatataatgaaaccaagtcaggggagtgaatttatcaatcttttgatgtaaagtaaaaacgtagttcacacttcaggagagaacttcatagcacaatgtctttctataagatatttttaatgatttagtattttacaacatttgtttaccatattttgatataccatttttttctatctgcccagttttattaaaaaaactatatattattttctaaagaaacaatcatatttttatacaaaattatgttttcaggtaacgaaatagatgtagggtacagtggaacataagcagtgttacccctggctgggagtcagtattatacaacaaatggtgagctggaacatgccctgtctgtgctgtccctcctgtgctgggtcgcggatgtgtaggcaacattgccttatcacgctaggttcacctgacactttaaaaggaaaaaaagttccatagagttctgtggtcacaaaattgttttgcttttatcaaatactttaatagaaccaaagttgcagatattggaatgtatggaagtatctcagtctctgcataagaggattaaagtatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgtttttaaaaataaaaaggaaaggaaatatataaagctgttatttattctgcatttcttacatatctatcgcttgtcagtatacccgttttggtatatattgcctctgcacatctacatttgtatatgcaacagtgagctttatatctacataaactgtaaataatcctttctgtgaaaggatcatcatatcaagatgataccaaaagtatgtaaaaagaaacctgcattattttgtaattatttcttatagatatttcatggtaagattagcagtcaataaagttacttttttgcctttaaa

SEQ ID NO: 2359 - DNA, 1679 bp, Homo sapiens
agaggctgggaagtccgggattgaggggccagcatctaccaagggccttcttgttacttcatcccatgatggaaggtggaagggtaaagagaggagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgca

SEQ ID NO: 2360 - DNA, 569 bp, Homo sapiens
tcaagactttctccgaggtatgaacaagaaccaggcgtctgggccctttccgctcgccccatcgctcagccgccgcgccccggacgcccgctgtgccccctgccggcggggcggcggcgggactgggtttcgggagggtttctggaagtcgcgagtcccagcgaaggcagtgcaccgctctccgcctctttcttcgccttcttctcgctcccttagctctgggtgtcgggcaccggtgctatgaaacccacgtagtcgaacaccgtgatgcttctcctgcagggcgtgtgatgaggaggcgagcttggctttggagtgctgggaacctgaggaattgccaaggacccagagcccagccctgaccaccagagtgcccaaaacacaatgaacaaattgaattttcataacaacagagtcatgcaagaccgccgcagtgtgtgcattttccttcccaacgatgaatctctgaacatcatcataaatgttaagattctgtgtcaccagttgctggtccaggtttgtgacctgctcaggctaaaggactgccacctctttggactcagtgttat

SEQ ID NO: 2361 - DNA, 4855 bp, Homo sapiens
gcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagtcacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgtttgtttgtttgcaatacactcagtgcagccttaagcaaatgagatcattttcagatttcattttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaa

SEQ ID NO: 2362 - DNA, 1321 bp, Homo sapiens
gcggccgctgcccgctttgcgccgctcctccctgcgcgagtagcgctggccccggcgtcgaggcggccatggcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccaatggtgtcctcatcctccttcctcaaagccaccggctcctcctggacgggttgggtactgagatgctccatgaagcccaagcaccattcacatctaattgagaagtttggagaggacagaattctcactcatcttacaggctctatttcttacacaaactgggctggaagtagaagcttagcggtcacagtcactgaagagcttcttaatcttttttgagtcaggacttgaagtcctgtttcattatttcattcaaagaaattgattggcaatggccagagttaaattcaaaggtgacattaacacatttcagtgcccaataagtgatttttctgctgggtaggagtagatacagatgtgatctcagatacgtgaagctgcatacagaggggcccatccactcctaaacgggtctccaggaggcttggtttgatctactagatttggtgcctcttaaagggaagcaatacagcttttctgctgtgggttgtttgccactaggggaagattcatttctattccagccataaattagaccaaagagagggatttggtttattgctagtgcagaagttaaaaaccatcttcctttcctgagtggtctcttaattagattctttagtttttaaatgttaactggaattgctgaagtttaattcctgaaagggtttagtttttaaaaggagtacctcatttaccatattactgtgttctgagaaatctacagtaatttttgtgtaacttttttattcaaagaatggattgttaattgtaaagccatttagaaaggcgaataaagtcagatctactttaa

SEQ ID NO: 2363 - DNA, 2301 bp, Homo sapiens
gcggccgctgcccgctttgcgccgctcctccctgcgcgagtagcgctggccccggcgtcgaggcggccatggcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaaggctggagtgcaatggcgcgatctcggctcactgcagcctccgcctcccaggttcaagcca

SEQ ID NO: 2364 - DNA, 5012 bp, Homo sapiens
gcggccgctgcccgctttgcgccgctcctccctgcgcgagtagcgctggccccggcgtcgaggcggccatggcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaaggcctggctccttttcccttattaggactccacacttaggacaagccaggcgcatcccatgtgctccagagaggaggccattgttattagtaaaggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagtcacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgtttgtttgtttgcaatacactcagtgcagccttaagcaaatgagatcattttcagatttcattttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggc

SEQ ID NO: 2365 - DNA, 578 bp, Homo sapiens
ggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggtaagcagcagtggcctcactatgcactgcgcggggagcagaaaggaggcatcggagggacttacatttgaaccttttgaagagagacccttgcaaagcaaaatgtcctctttccatccacctgggagacaactggaaaaacacaacagtgtcgttagttcagaatcattgtgttcggaggagataaagcaatcctctgacctcatattctgctttttctccttacggggtgattcgcttctttaccttttcccctaccatatcccacagaagatttgagattgcttattttattttttttaaatgtacataaatgaaaatggaaaattaaaaaaaaaattaggtaaatagtaataaagccagaaaggtagtgcattaaattatgctagaaattcc

SEQ ID NO: 2366 - DNA, 550 bp, Homo sapiens
gctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaaggctggagtgcaatggcgcgatctcggctcactgcagcctccgcctcccaggttcaagcc

SEQ ID NO: 2367 - DNA, 4051 bp, Homo sapiens
ggggtcagggcggggcgcgctgcgcgggggctgccggcgggcagttgggagcaggcgacgccgacgcgagtctggcggctgctgcttgcgactgcggaggccgggcgaggccggtgaggacgcggcgggcgagcgagaggccgaggtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaggccaaagaatgtggtgcttcgcctagctgtaaaattttttccacctgatcctggtcagctacaagaagaatatacaagatacttgtttgccttgcaacttaagagagacctgctggaagagcgtttgacctgtgctgacaccacagcggcccttctcacgtcccatctcctgcagtcggaaataggagattacgatgaaacgctggaccgagagcacctcaaagtgaacgagtatttgcctggccagcagcactgccttgagaagatactagaattccatcagaagcacgtgggccagacacctgctgagtcggatttccaggtgctcgaaattgctcgaaagttggaaatgtacggcatcagatttcacatggcttctgacagggaaggaaccaagattcaactggcagtttcccacatgggtgtactcgtgttccagggcaccaccaaaatcaacactttcaactggtccaaggtccgtaaactaagcttcaagaggaaaagatttcttatcaaacttcatccagaggttcatggaccttaccaggacacattagaatttttgttgggtagtagagatgaatgtaagaacttctggaagatttgtgtggagtatcacaccttttttagacttttggaccaacctaagccaaaagcaaaagccgtcttcttcagccggggctcctccttcagatacagtggaagaactcagaaacaactagtagattatttcaaagacagtggaatgaagagaattccatatgaaagaaggcacagcaagacccacacgtccgttcgagctctgactgcagacctaccaaaacagagcatctcattccccgagggattgaggactcctgcctccccatcttcagcgaatgccttttactcgctctctccctccactctggtcccctctggcctgccagagtttaaggacagcagcagctccctcacagatccccaggtttcctacgtcaagagtccagctgcagagaggcgcagtggagcagtggctggaggccccgacacaccatcggcccagcccctcgggccccccgcactccagcctggtccaggcctttccacgaagagtcctcagccttctccctccagccggaagagccccctgagtctgagccctgcatttcaggtgcctttgggcccagctgaacagggctcatccccactcctgagccctgtcctcagtgatgctggcggagccgggatggactgcgaggagcccagacacaagcgcgtgcctgcagacgaggcctacttcatagtcaaagagattctcgctacagaacgaacatacctcaaggatttagaagttattaccgtgtggttccgcagcgcagtggtgaaggaggacgccatgcctgcgactctgatgacgctgctcttctccaacatcgatcccatctatgagttccacagaggcttcctgcgcgaggtggagcagaggctggcactctgggaagggccctccaaagcccacacaaaaggcagtcatcaacgaatcggggacatcctgctcaggaacatgcgccagttaaaggagtttaccagctacttccaaagacatgacgaggtcctaacagaactggaaaaggctaccaaacgctgtaagaagttggaggcagtgtacaaggagtttgagctgcagaaggtctgctacttgcctctcaacacgttcctgctgaagcccatccagcggctgctgcactaccgcctgctgctgcgccgcctatgcggacattacagccccgggcaccatgactacgctgactgccatgacgccctgaaagccatcacagaggtgaccaccacactacagcacattctcatccggctggagaacctgcagaagctaacggagctgcagcgggacctggtgggcatagagaacctcattgctcctggcagggagttcatccgtgagggctgccttcacaagctcaccaagaagggcctgcagcagaggatgttttttctgttctcagatatgttgctgtacacaagcaaaggagttgcagggaccagccacttccggatccggggcctccttcccctccaaggcatgctggtggaagaaagtgataacgagtggtctgttccacactgtttcaccatctacgcggctcagaaaacaatcgtggtggcagccagcactcggctggagaaagagaagtggatgctggacctgaactccgcgatccaagcagccaagagtggcggtgacacggcccctgcactgccaggccgcactgtgtgcactcgtccccccagatcccccaacgaggtatctctggagcaggagtcagaagatgatgctcggggtgtccgcagctccctggaggggcatggccagcaccgggccaacaccacaatgcacgtgtgctggtaccggaacaccagcgtgtccagggcagaccacagtgcagctgtcgagaaccagctttcaggatatctgctaagaaagttcaaaaacagtcatggctggcagaagctctgggtcgtctttaccaacttctgtttgttcttctacaaaactcatcaggatgactacccactggccagcctcccgctgctgggctacagcgtgagcatccccagggaggccgatggcatacacaaagactatgttttcaagctccagttcaaatcccacgtctacttcttccgggctgagagcaagtacacatttgaaaggtggatggaggtgatccagggggccagcagctcagccgggagggccccaagcatcgtgcaggatggcccccaaccctcctcagggctggaggggatggtcagggggaaggaggaatgacgctcaacctgcccaggtttggacacaactacaaagaacagcaggacacagaggtgacctctgtcctgaggcttctcaacagatgggaagtggctgtggtctcactggatccccactggcaccagcagtgtgggtgggcctcatgtaacatctgggaggggcttcatccccccacccaggacctagtgcatgccagcagctatctggggccctgggaaaaatgtgcgagtcttgagcgcggagccgctcaagccacagctcccaggcccctggctcaaagacgcagacaaggcctgagcagtgctctcggcatcggaccaaagcctgggcacaccctgcctctctccccagagcagggtccctgccgaggactggcctagagcaagcactggaaaagaggccctgccatacaccctgcgtacccactgccaggaccctctcagacaagcgtggcacagccatgctgaccttccatctggtgaaccaagtggcagccccaggggcctgccctgcaggtcacagctaaacaagtctggcagaagccacgcttgttccccatgtacctctagagaagcagaaaccaaagtccccctgtgccctgggagggtggggccgtctaatttattactgcccagcattccttccaacgggaagtagatgggcgactgctttgttcacacacatttgattaaaaataaacaaacagcatctcccca

SEQ ID NO: 2368 - DNA, 2580 bp, Homo sapiens
gcgacgccgacgcgagtctggcggctgctgcttgcgactgcggaggccgggcgaggccggtgaggacgcggcgggcgagcgagaggccgaggtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaggccaaagaatgtggtgcttcgcctagctgtaaaattttttccacctgatcctggtcagctacaagaagaatatacaagatacttgtttgccttgcaacttaagagagacctgctggaagagcgtttgacctgtgctgacaccacagcggcccttctcacgtcccatctcctgcagtcggaaataggagattacgatgaaacgctggaccgagagcacctcaaagtgaacgagtatttgcctggccagcagcactgccttgagaagatactagaattccatcagaagcacgtgggccagacacctgctgagtcggatttccaggtgctcgaaattgctcgaaagttggaaatgtacggcatcagatttcacatggcttctgacagggaaggaaccaagattcaactggcagtttcccacatgggtgtactcgtgttccagggcaccaccaaaatcaacactttcaactggtccaaggtccgtaaactaagcttcaagaggaaaagatttcttatcaaacttcatccagaggttcatggaccttaccaggacacattagaatttttgttgggtagtagagatgaatgtaagaacttctggaagatttgtgtggagtatcacaccttttttagacttttggaccaacctaagccaaaagcaaaagccgtcttcttcagccggggctcctccttcagatacagtggaagaactcagaaacaactagtagattatttcaaagacagtggaatgaagagaattccatatgaaagaaggcacagcaagacccacacgtccgttcgagctctgactgcagacctaccaaaacagagcatctcattccccgagggattgaggactcctgcctccccatcttcagcgaatgccttttactcgctctctccctccactctggtcccctctggcctgccagagtttaaggacagcagcagctccctcacagatccccaggtttcctacgtcaagagtccagctgcagagaggcgcagtggagcagtggctggaggccccgacacaccatcggcccagcccctcgggccccccgcactccagcctggtccaggcctttccacgaagagtcctcagccttctccctccagccggaagagccccctgagtctgagccctgcatttcaggtgcctttgggcccagctgaacagggctcatccccactcctgagccctgtcctcagtgatgctggcggagccgggatggactgcgaggagcccagacacaagcgcgtgcctgcagacgaggcctacttcatagtcaaagagattctcgctacagaacgaacatacctcaaggatttagaagttattaccgtgtggttccgcagcgcagtggtgaaggaggacgccatgcctgcgactctgatgacgctgctcttctccaacatcgatcccatctatgagttccacagaggcttcctgcgcgaggtggagcagaggctggcactctgggaagggccctccaaagcccacacaaaaggcagtcatcaacgaatcggggacatcctgctcaggaacatgcgccagttaaaggtgttccagctccacgaagggcatgtagcaggggtcacaaaaatggagtagacttttggataggcaggggcagcactgggggaagtgagatttctcttcaataggagcaacggtacaggtgttcacatgtggacaacagtgcaggtcgtgcattgactgttcaggggtctcactcttgcttaacgtgcctggaacagttctccctccctctcaggctgctcatgagttcaccacgtgaccgcccaaggtgtggagctctgcataacaccatgaagctgagccacagtgacgacgacgactcaagctccccctcctccatccctcgcctgtcccaccttctacccaatcctgcgagactctggccactcctcacacctagagttcccaagggactataggttttgctgttctgtgttgagatagccccacttgaagaactgcattcagcctaggtgcccttttcctgcctcgacggaagctgagtcaggttgttaatgagaaagttctacttatcccaaaggcagttgcactaatttaaaattgaaatatacacaaatctgtttgatccaga

SEQ ID NO: 2369 - DNA, 550 bp, Homo sapiens
tcaaatcccacgtctacttcttccgggctgagagcaagtacacatttgaaaggtggatggaggtgatccagggggccagcagctcagccgggagggccccaagcatcgtgcaggatggcccccaaccctcctcagggctggaggggatggtcagggggaaggaggaatgacgctcaacctgcccagagcagggtccctgccgaggactggcctagagcaagcactggaaaagaggccctgccatacaccctgcgtacccactgccaggaccctctcagacaagcgtggcacagccatgctgaccttccatctggtgaaccaagtggcagccccaggggcctgccctgcaggtcacagctaaacaagtctggcagaagccacgcttgttccccatgtacctctagagaagcagaaaccaaagtccccctgtgccctgggagggtggggccgtctaatttattactgcccagcattccttccaacgggaagtagatgggcgactgctttgttcacacacatttgattaaaaataaacaaacagcatctcccc

SEQ ID NO: 2370 - DNA, 456 bp, Homo sapiens
acaataactgtttgggctggtggcgagagtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaggccaaagaatgtggtgcttcgcctagctgtaaaattttttccacctgatcctggtcagctacaagaagaat

SEQ ID NO: 2371 - DNA, 538 bp, Homo sapiens
agcatctggaaatattgttattgagggtggtgcttgttattttatgctccacctatgagtgcctgagtagaaaataatcttttgtaacactttcttttgacgtgattaagactcacagaagttgcagtaatagtacagaggattcccgtgtctccgataatttgtcttttaccttgttttagtacctaaataatgtgataattccttcatgtggtttttttttttttcattttagtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcag

SEQ ID NO: 2372 - DNA, 2122 bp, Homo sapiens
gggagcaggcgacgccgacgcgagtctggcggctgctgcttgcgactgcggaggccgggcgaggccggtgaggacgcggcgggcgagcgagaggccgaggtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaggccaaagaatgtggtgcttcgcctagctgtaaaattttttccacctgatcctggtcagctacaagaagaatatacaagatacttgtttgccttgcaacttaagagagacctgctggaagagcgtttgacctgtgctgacaccacagcggcccttctcacgtcccatctcctgcagtcggaaataggagattacgatgaaacgctggaccgagagcacctcaaagtgaacgagtatttgcctggccagcagcactgccttgagaagatactagaattccatcagaagcacgtgggccagacacctgctgagtcggatttccaggtgctcgaaattgctcgaaagttggaaatgtacggcatcagatttcacatggcttctgacagggaaggaaccaagattcaactggcagtttcccacatgggtgtactcgtgttccagggcaccaccaaaatcaacactttcaactggtccaaggtccgtaaactaagcttcaagaggaaaagatttcttatcaaacttcatccagaggttcatggaccttaccaggacacattagaatttttgttgggtagtagagatgaatgtaagaacttctggaagatttgtgtggagtatcacaccttttttagacttttggaccaacctaagccaaaagcaaaagccgtcttcttcagccggggctcctccttcagatacagtggaagaactcagaaacaactagtagattatttcaaagacagtggaatgaagagaattccatatgaaagaaggcacagcaagacccacacgtccgttcgagctctgactgcagacctaccaaaacagagcatctcattccccgagggattgaggactcctgcctccccatcttcagcgaatgccttttactcgctctctccctccactctggtcccctctggcctgccagagtttaaggacagcagcagctccctcacagatccccaggtttcctacgtcaagagtccagctgcagagaggcgcagtggagcagtggctggaggccccgacacaccatcggcccagcccctcgggccccccgcactccagcctggtccaggcctttccacgaagagtcctcagccttctccctccagccggaagagccccctgagtctgagccctgcatttcaggtgcctttgggcccagctgaacagggctcatccccactcctgagccctgtcctcagtgatgctggcggagccgggatggactgcgaggagcccagacacaagcgcgtgcctgcagacgaggcctacttcatagtcaaagagattctcgctacagaacgaacatacctcaaggatttagaagttattaccgtgtggttccgcagcgcagtggtgaaggaggacgccatgcctgcgactctgatgacgctgctcttctccaacatcgatcccatctatgagttccacagaggcttcctgcgcgaggtggagcagaggctggcactctgggaagggccctccaaagcccacacaaaaggcagtcatcaacgaatcggggacatcctgctcaggaacatgcgccagttaaaggctgctcatgagttcaccacgtgaccgcccaaggtgtggagctctgcataacaccatgaagctgagccacagtgacgacgacgactcaagctccccctcctccat

SEQ ID NO: 2373 - DNA, 5151 bp, Homo sapiens
ctggagtctcccctggtcgggagcctcagccttctggagactgacaccaccctcttactcagagacgaatcgttttgtcgttgccttcacctccctgaccacaagtgctccggggctctttctgagggaggcagctgttctaggcgggaggctggagtctcctgggcctggacgcaccccggggtgtgagtgatgggtatgcctgaaaggaggggaagtggcgcggctttaatcatctgggctagtccccggcgggcctgggggaacagggaaactggaggcggccttaaagcgtcaggatgagacatcgcaagaggagctgcagatactgagcgtgcgccccgggttctcgccgccttctctccgccgagcagcccttcggccaccctttgcccttaaaaatctgcagactgcgcctcctctccgcgggagcgagacctagcaggcccggggctgggcgtgccctcgcctgccacgctgcgcgctgccctcagccgggccgctggggccgtgcagtgcaccgggcacgccgcgccaggctgggggcaggcaccgagcctccgtgggaggtcccgaggcagcttcgcctgctcgccctggctccagccctcacctgccgcagccttagctgagcagccgccgccactgggcgccccccgctccccacttcgccagcgcccgctcctcggctcggcccggggtagtttgtagggacgcagctctccacgtgcgcgactgcgaggctggacgctacgggctcctggaaaggagacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaagttagtagaacagatcaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaagaagaagaagaaaaaagacaaaaataataaggaacccataattgaagatattctaaacctggagagttctccaacagcttcaggttcatcagtaagtcctggtttatacagtaaaaccatgacccctatatatgaccccatcaatggaacaccagcatcatccaccatgacttggttcagtgacagccctttgacggaacaaaactgcagcatcctcgcattcagccaacccccccagtccccagaagcacttgcggatatgtaccagcctcggtctctggttgataaagccaagctcaatgcaggttggctagactcctcacgctcccttatggaacaaggcatccaagaggatgagcagctgctcttacgatttaaatattattctttcttcgacttgaatcctaaatatgatgctgtccgaataaaccaactctatgagcaagccaggtgggccattctcttagaagaaattgattgcacagaggaagaaatgttgatctttgcagctctacagtaccacattagcaaactgtcgttgtctgctgaaacacaggattttgcaggcgagtccgaggttgatgaaatagaagcggcgctttctaatttggaagtaaccctagaaggtggaaaagcggacagccttttggaggacattactgatatccctaaacttgcagataatctcaaattatttaggcccaagaagttactaccaaaagctttcaaacaatattggtttatctttaaagacacatccatagcatactttaaaaataaggaacttgaacaaggagaaccactagaaaaactaaatcttagaggctgcgaagttgtgcccgatgtaaatgtagcaggaagaaaatttggaatcaagttactaatccctgttgccgatggtatgaatgaaatgtatttgagatgtgaccatgagaatcaatacgcccaatggatggctgcctgcatgttggcatcgaagggcaaaaccatggcagacagctcctaccagccagaggtcctcaacatcctttcatttctgaggatgaaaaacaggaactctgcatctcaggtggcttccagtctcgaaaacatggatatgaacccagaatgttttgtgtcaccacggtgtgcaaaaagacacaaatccaaacagctggccgcccggatcctggaggcgcaccagaacgtggcccagatgcccctggtcgaagccaagctgcggttcatccaggcgtggcagtcactgcctgagtttggcctcacctactaccttgtcagatttaaaggaagcaaaaaagatgacattctgggagtttcatataacaggttgattaaaattgatgcagccaccgggattccagtgacaacatggagattcacaaatatcaaacagtggaatgtaaactgggaaacccggcaggtggtcatcgagtttgaccaaaacgtctttactgctttcacctgcctgagtgcagattgcaagattgtgcacgagtacattggcggctacattttcttgtccacccgctccaaggaccagaatgaaacactcgatgaggacttgttccacaaattgaccggcggtcaggattgaaacaagcacgcgtgctcggctcacaccaacaaggcaagccaaaggcgcccctccccagagggatccctaacgtgcccagcatgtagattctggactaacagacaacatacattcaccgctggtcacccagatcctcattcaaacccactgctggcacatccctttccttactttgccctgtgctaccagccacggaaggagcctctcttgttttttctataaaatgggtaggcaggagaaaagcaggtgccctaagattgctctaaggcccagcatgtggttacagttctctgacttgcagaacctgccaggtgtatggctacaagttatcctcgtgctgatctgtctcattactaagtcaatggagaagacagaaaggtaaaaatcacgtgtagcaagaacaactcttatttcacaaactcaggtatgaaacgaaacgcctgtccttcatggaactgcttttagctcctgtcttttcaaaatggcagagggagttcctacacacactttttccctggaggccaaggtctaggggtagaaaggggaggggtggggctaccaggtagcagttgacaacccaaggtcagaggagtggccctcagtgtcatctgtccacagtgatacctgccaagatgaccactgacccacatctggtcttagtcattggtctcctcagatttctggggccacctgcaagccccattccattcctacagatctctcagccacctgtaagtcctttgtgaagatgtgggtgacacagggggacaggaaaacccatttctcaacccagatccatgtctccactgcttctactctgggttgggattcaggaagacaggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctggatttggtatctatgttggtacgactcctggccttttatctaaaggactttggcttttgtaaatcacaagccaataatagacttttttctccccctctgttttttgctgtgtcatctctgccttgagactgccttgagacagtgcttgccttgagagagtgagccaattaacagctgcctgaattgtcattttccattttggtttgttagaggtgggaggggtgggttttgagaaggtcaaaagcaataccagaagtaaagggaaatatcagacaatattttattattttttcatagatgttctgccacacaaagaacttggggtgtaaggataaggcaaaagctccaatcccatttttcagttctcctaggatgcacccctcagggagcctggccagagttccgaggcccgtgagcgtcagctgttgctttattttccatcaaagccctctgagaagtgagacctcagcaattccgggagccacatagagacagacttggcaagggaccccctggttctgagccagtagctgccatctggaaattcctcttttagcctctccttagaggtgaatgtgaatgaagcctcccaggcacccgctgaatttctgaggccttgcttaaagctcagaagtggtttaggcatttggaaaatctggttcacatcataaagaacttgatttgaaatgttttctatagaaacaagtgctaagtgtaccgtatatacttgatgttggtcatttctcagtcctatttctcagttctattattttagaacctagtcagttctttaagattataactggtcctacattaaaataatgcttctcgatgtcagattttacctgtttgctgctgagaacatctctgcctaatttaccaaagccagaccttcagttcaacatgcttccttagcttttcatagttgtctgacatttccatgaaaacaaaggaaccaactttgttttaaccaaactttgtttggttacagttttcaggggagcgtttcttccatgacacacagcaacatcccaaagaaataaacaagtgtgacaaaaaaaaaaaaaaacaaacctaaatgctactgttccaaagagcaacttgatggttttttttaatactgagtgcaaaaggtcacccaaattcctatgatgaaattttaaattaatgggcacctttcaacatcatttgcttccttatctacagttgattcagaaatctgcattttttattcttttatatgacttttaagtaaaagatttatatggatttga

SEQ ID NO: 2374 - DNA, 2457 bp, Homo sapiens
ctggagtctcccctggtcgggagcctcagccttctggagactgacaccaccctcttactcagagacgaatcgttttgtcgttgccttcacctccctgaccacaagtgctccggggctctttctgagggaggcagctgttctaggcgggaggctggagtctcctgggcctggacgcaccccggggtgtgagtgatgggtatgcctgaaaggaggggaagtggcgcggctttaatcatctgggctagtccccggcgggcctgggggaacagggaaactggaggcggccttaaagcgtcaggatgagacatcgcaagaggagctgcagatactgagcgtgcgccccgggttctcgccgccttctctccgccgagcagcccttcggccaccctttgcccttaaaaatctgcagactgcgcctcctctccgcgggagcgagacctagcaggcccggggctgggcgtgccctcgcctgccacgctgcgcgctgccctcagccgggccgctggggccgtgcagtgcaccgggcacgccgcgccaggctgggggcaggcaccgagcctccgtgggaggtcccgaggcagcttcgcctgctcgccctggctccagccctcacctgccgcagccttagctgagcagccgccgccactgggcgccccccgctccccacttcgccagcgcccgctcctcggctcggcccggggtagtttgtagggacgcagctctccacgtgcgcgactgcgaggctggacgctacgggctcctggaaaggagacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaagttagtagaacagatcaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaagaagaagaagaaaaaagacaaaaataataaggaacccataattgaagatattctaaacctggagagttctccaacagcttcaggttcatcagtaagtcctggtttatacagtaaaaccatgacccctatatatgaccccatcaatggaacaccagcatcatccaccatgacttggttcagtgacagccctttgacggaacaaaactgcagcatcctcgcattcagccaacccccccagtccccagaagcacttgcggatatgtaccagcctcggtctctggttgataaagccaagctcaatgcaggttggctagactcctcacgctcccttatggaacaaggcatccaagaggatgagcagctgctcttacgatttaaatattattctttcttcgacttgaatcctaaatatgatgctgtccgaataaaccaactctatgagcaagccaggtgggccattctcttagaagaaattgattgcacagaggaagaaatgttgatctttgcagctctacagtaccacattagcaaactgtcgttgtctgctgaaacacaggattttgcaggcgagtccgaggttgatgaaatagaagcggcgctttctaatttggaagtaaccctagaaggtggaaaagcggacagccttttggaggacattactgatatccctaaacttgcagataatctcaaattatttaggcccaagaagttactaccaaaagctttcaaacaatattggtttatctttaaagacacatccatagcatactttaaaaataaggaacttgaacaaggagaaccactagaaaaactaaatcttagaggctgcgaagttgtgcccgatgtaaatgtagcaggaagaaaatttggaatcaagttactaatccctgttgccgatggtatgaatgaaatgtatttgagatgtgaccatgagaatcaatacgcccaatggatggctgcctgcatgttggcatcgaagggcaaaaccatggcagacagctcctaccagccagaggtcctcaacatcctttcatttctgaggatgaaaaacaggaactctgcatctcaggtggcttccagtctcgaaaacatggatatgaacccagaatgttttgtgtcaccacggtgtgcaaaaagacacaaatccaaacagctggccgcccggatcctggaggcgcaccacctgcaagccccattccattcctacagatctctcagccacctgtaa

SEQ ID NO: 2375 - DNA, 567 bp, Homo sapiens
ccagttaccccctgaaacatttcagttgtgaacgttctttcctgctagcttctcccatgaggggaaaacgatgggtttgaaattcacatccctatctgtactttgaagaacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaagttagtagaacagatcaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaa

SEQ ID NO: 2376 - DNA, 3229 bp, Homo sapiens
agtgcaccgggcacgccgcgccaggctgggggcaggcaccgagcctccgtgggaggtcccgaggcagcttcgcctgctcgccctggctccagccctcacctgccgcagccttagctgagcagccgccgccactgggcgccccccgctccccacttcgccagcgcccgctcctcggctcggcccggggtagtttgtagggacgcagctctccacgtgcgcgactgcgaggctggacgctacgggctcctggaaaggagacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaagaagaagaagaaaaaagacaaaaataataaggaacccataattgaagatattctaaacctggagagttctccaacagcttcaggttcatcagttggctagactcctcacgctcccttatggaacaaggcatccaagaggatgagcagctgctcttacgatttaaatattattctttcttcgacttgaatcctaaatatgatgctgtccgaataaaccaactctatgagcaagccaggtgggccattctcttagaagaaattgattgcacagaggaagaaatgttgatctttgcagctctacagtaccacattagcaaactgtcgttgtctgctgaaacacaggattttgcaggcgagtccgaggttgatgaaatagaagcggcgctttctaatttggaagtaaccctagaaggtggaaaagcggacagccttttggaggacattactgatatccctaaacttgcagataatctcaaattatttaggcccaagaagttactaccaaaagctttcaaacaatattggtttatctttaaagacacatccatagcatactttaaaaataaggaacttgaacaaggagaaccactagaaaaactaaatcttagaggctgcgaagttgtgcccgatgtaaatgtagcaggaagaaaatttggaatcaagttactaatccctgttgccgatggtatgaatgaaatgtatttgagatgtgaccatgagaatcaatacgcccaatggatggctgcctgcatgttggcatcgaagggcaaaaccatggcagacagctcctaccagccagaggtcctcaacatcctttcatttctgaggatgaaaaacaggaactctgcatctcaggtggcttccagtctcgaaaacatggatatgaacccagaatgttttgtgtcaccacggtgtgcaaaaagacacaaatccaaacagctggccgcccggatcctggaggcgcaccagaacgtggcccagatgcccctggtcgaagccaagctgcggttcatccaggcgtggcagtcactgcctgagtttggcctcacctactaccttgtcagatttaaaggaagcaaaaaagatgacattctgggagtttcatataacaggttgattaaaattgatgcagccaccgggattccagtgacaacatggagattcacaaatatcaaacagtggaatgtaaactgggaaacccggcaggtggtcatcgagtttgaccaaaacgtctttactgctttcacctgcctgagtgcagattgcaagattgtgcacgagtacattggcggctacattttcttgtccacccgctccaaggaccagaatgaaacactcgatgaggacttgttccacaaattgaccggcggtcaggattgaaacaagcacgcgtgctcggctcacaccaacaaggcaagccaaaggcgcccctccccagagggatccctaacgtgcccagcatgtagattctggactaacagacaacatacattcaccgctggtcacccagatcctcattcaaacccactgctggcacatccctttccttactttgccctgtgctaccagccacggaaggagcctctcttgttttttctataaaatgggtaggcaggagaaaagcaggtgccctaagattgctctaaggcccagcatgtggttacagttctctgacttgcagaacctgccaggtgtatggctacaagttatcctcgtgctgatctgtctcattactaagtcaatggagaagacagaaaggtaaaaatcacgtgtagcaagaacaactcttatttcacaaactcaggtatgaaacgaaacgcctgtccttcatggaactgcttttagctcctgtcttttcaaaatggcagagggagttcctacacacactttttccctggaggccaaggtctaggggtagaaaggggaggggtggggctaccaggtagcagttgacaacccaaggtcagaggagtggccctcagtgtcatctgtccacagtgatacctgccaagatgaccactgacccacatctggtcttagtcattggtctcctcagatttctggggccacctgcaagccccattccattcctacagatctctcagccacctgtaagtcctttgtgaagatgtgggtgacacagggggacaggaaaacccatttctcaacccagatccatgtctccactgcttctactctgggttgggattcaggaagacaggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctggatttggtatctatgttggtacgactcctggccttttatctaaaggactttggcttttgtaaatcacaagccaataatagacttttttctccccctc

SEQ ID NO: 2377 - DNA, 1012 bp, Homo sapiens
gagtcacgtgatgcatgtcatggccgcctccatggcccggggaggcgtgagtgccagggttctactgcaggctgccaggggcacctggtggaacagacctgggggcacttccgggtcgggggagggggtggcgctggggacaaccagaaagtttcaagcgacaggctcgcgcccggctggagaggaggacgcgggcggcccggagcggcccggggacgtggtgaacgtggtgttcgtagaccgctcaggccagcggatcccagtgagtggcagagtcggggacaatgttcttcacctggcccagcgccacggggtggacctggaaggggcctgtgaagcctccctggcctgctccacctgccatgtgtatgtgagtgaagaccacctggatctcctgcctcctcccgaggagagggaagacgacatgctagacatggcccccctcctccaggagaactcgcggctgggctgccagattgtgctgacaccggagctggaaggagcggaattcaccctgcccaagatcaccaggaacttctacgtggatggccatgtccccaagccccactgacatgaacacctggaccattccacattgccatggccccagggcccagattgagggaatagccaggtgccagccctgcccagagtgcggacaggcccgggagagacgtggaagcccctgtgaaggacaacacccctgcttgggagagagtcccatgtccaggctctggtggggacagggcccctagtggggtggccttccccaggcccctgagaatcagggtttgagtaggagtggactcatattggagctgcaataaatcgataacacaggccccagcatgttgagtgtccttgggggacagatctggggtctacaggtggctcacacctgtaatcctagcactttgggaagccaagatgggaggatcacttgaggccaggagcttaagaccatcctgggcaacatggcgagacctcgtctctataaaaacagtaaaaatta

SEQ ID NO: 2378 - DNA, 1956 bp, Homo sapiens
cgtgatgcatgtcatggccgcctccatggcccggggaggcgtgagtgccagggttctactgcaggctgccaggggcacctggtggaacagacctgggggcacttccgggtcgggggagggggtggcgctggggacaaccagaaagtttcaagcgacaggctcgcgcccggctggagaggaggacgcgggcggcccggagcggcccggggacgtggtgaacgtggtgttcgtagaccgctcaggccagcggatcccagtgagtggcagagtcggggacaatgttcttcacctggcccagcgccacggggtggacctggaaggggcctgtgaagcctccctggcctgctccacctgccatgtgtatgtgagtgaagaccacctggatctcctgcctcctcccgaggagaggagaactcgcggctgggctgccagattgtgctgacaccggagctggaaggagcggaattcaccctgcccaagatcaccaggaacttctacgtggatggccatgtccccaagccccactgacatgaacacctggaccattccacattgccatggccccagggcccagattgagggaatagccaggtgccagccctgcccagagtgcggacaggcccgggagagacgtggaagcccctgtgaaggacaacacccctgcttgggagagagtcccatgtccaggcccctgagaatcagggtttgagtaggagtggactcatattggagctgcaataaatcgataacacaggccccagcatgttgagtgtccttgggggacagatctggggtctacaggtggctcacacctgtaatcctagcactttgggaagccaagatgggaggatcacttgaggccaggagcttaagaccatcctgggcaacatggcgagacctcgtctctataaaaacagtaaaaattagcgtggagtggtggtaagtgcctgtagtcccagctactcgggagactgaggtgggaggatcacttgagcccaggggatttaggctgcagtggagcggtgatcaggccattccactccagcctgggtgacagagtgaggccctgtctcaaaaaaaaaaaaaacaaaaacaaaaacaaaccacacctgcatctgctgtgctgggcccccggttctcttttccctctgggatctaagatgccgctggggatccaaggcagaggcctgggagcccccatttccgagggggagggctagcgtggaaggccccgccccggcagctgcggagggatttggtggggtccaggccgcccttgccacgcaggggtgcgcggatgacctgaaaaaagccagaaagaggaaaggtgccgccgaggctggtcgctctcagctggggctcatcgcatcctctaccaagagcgctcccaccacacaggtcccgcccctcccagcaaagcttctggcgccgccctgtctgaacctggagcggctgggaggatccccctcccaggagaagccgaggaccccaggatgctgcagaatcagtgagaggtccctctggcctgcatgccaggagtcggtcaccgccctgtgcttcctccaagagacagtggagaggctggggattccaaggacacacagaccaggatcagccaaaagggccgccgtctgcagcccccggggactccctcggccccaccccagagaaggccccggaaacagctgaacccctgccggggcaccgagagagtggaccctgggttcgagggggtgactctgaagtttcagataaagccggactccagcctgcagatcatccccacgtacagcctgccctgcagtagccgttctcaggaatcccctgcagatgctgttgggggccctgcagcccacccaggaggcaccgaggcccactcagcaggcagcgaggccctggagccccggcgctgtgcttcctgtcggacccagaggaccccgctctggagagacgctg

SEQ ID NO: 2379 - DNA, 1072 bp, Homo sapiens
agaggtgattttctgagtgtgactcctctgttcctggcaccctgtgcatccttagccatagcttacaagagaacagctggttgtgatggcaggaggccctcccaacaccaaggcggagatggaaatgtccctggcagaagaactgaatcatggacgccaaggggaaaaccaagagcacctggtgatagcagaaatgatggagcttggatctcggtcccggggtgcctcccagaagaagcagaagttggaacaaaaagctgctggctctgcttcagccaaacgagtttggaatatgactgccacccgacccaagaaaatggggtcccagctgccaaagcccagaatgctgagagaatcaggccatggggatgcccatctccaggagtacgctggcaatttccaaggcatacgtttccattatgatcgcaacccagggacagatgcagtggcgcagactagcctggaagagttcaatgtactggagatggaagtcatgagaagacagctgtatgcagtcaaccggcgtctgcgcgccctggaggaacagggcgccacctggcgccacagggagaccctgatcatcgccgtgctggtgtcggccagcattgccaacctgtggctgtggatgaaccagtgatcgccccagcgcggcctccgtattggagccctccctgcttccccttctttctttcctctttccccaggccgccactgcccttgcccctttcatctcccagcagccctcaggagcgtcaggatcattttcaactctggttaggcctcctacctggggaggccaggtcactgcactgggaggtcctggctgctgcgaagctggaggaggactgcgtgggctgagatgccaccctttgaagggtgaacagcatggcggcatctgggccccacagtaacacctagtggcaaccttgccttcctgacctcagcggcccttctgttccatcctctgtgggcaggggtgtggctttgttttcctccctcgtttgcttccacctcgtgcacagcgctctgcacagacaacacgctcaataaaagttcagccatagcagcaaaa

SEQ ID NO: 2380 - DNA, 6861 bp, Homo sapiens
aaaacccttccctcccccgctcccccggaagtgcttttccaagattcgggccggagagaggccttgtaggcacagcggctgagactcgatctgctccaagtaggggctccagcgcgggtcggagtctgggggttcgcgcccgccgacccgcgccctgctccctctcagcacctgggcggacgaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggagattttcttctttctaccatcatcaagatcaagcaggcaagtttacttgctgtcatcttctgcaaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggcataatggaacttacagacacagaactgattttatacacccgcaaacgtgactcagtaaaatggcactacctctgcctgcgacgctatggctatgactcgaatctcttttcttttgaaagtggtcgaaggtgtcaaactggacaaggaatctttgcctttaagtgtgcccgtgcagaagaattatttaacatgttgcaagagattatgcaaaataatagtataaatgtggtggaagagccagttgtagaaagaaataatcatcagacagaattggaagtccctagaacacctcgaacacctacaactccaggatttgctgctcagaacttacctaatggatatccccgatatccctcatttggagatgcttcatcccatccgtcaagcagacatccttctgtgggaagtgctcgcctgccttcagtaggggaagaatctacacatcctttgcttgtggctgaggaacaagtacatacctatgtcaacactacaggtgtgcaagaagagcggaaaaaccgcacaagtgtgcatgttccattggaggcgagggtttctaacgctgaaagcagcacaccaaaagaagaaccaagtagtattgaggacagggatcctcagattcttcttgaacctgaaggagtcaaatttgttttagggccaacccctgttcaaaagcagttaatggaaaaagagaaactggagcaacttggaagagatcaagttagtggaagtggagcaaataacacagaatgggacactggctatgacagtgatgaacgaagagatgcaccctctgttaacaaactggtgtatgaaaatataaatgggctatctatccctagtgcctcaggggtcaggagaggtcgtctgacatccaccagtacctcagatacccagaatatcaacaactcagctcagagaagaactgcattattaaactatgaaaatctaccatctttgcctcctgtttgggaagcccgcaagctaagtagggatgaagatgacaatttaggaccaaagaccccatctctaaatggctaccataataatctagatccaatgcataactatgtaaatacagagaatgtaacagtgccagcaagtgctcacaaaatagaatattcaaggcgtcgggactgtacaccaacagtctttaactttgatatcagacgcccaagtttagaacacaggcagcttaattacatacaggttgacttggaaggtggcagtgactctgacaaccctcagactccaaaaacgcctacaactccccttccacaaacccctaccaggcgcacagagctgtatgccgtgatagacatcgagagaactgctgctatgtcaaatttgcagaaagcactgccacgagatgatggtacatctaggaaaactagacacaatagtactgatctgcccatgtgagcctggaaagcattgtgttgtttgcacctttgtgaagtttttaaaaatgaagatgcaagtgcttcattttcatttctaaacactaactccttttatagactgataaaatttttttctgaatatttcatgtgcatctttaactaaagggaattaatgtagagcaggtactccttaaagaacactaatttcattatatactactcgttgtacagcagcattcccgttttcacagtgcctatttaaaatgagagttgaagtaaatgacatgctggttgatttttatcaatattctggacttaacgcatacctttcatgtctaagtcatggttggcttttaaaactttttataaagcctcttgacaatgtacattgctaacaggtaactataggctttgaaagtaatgctcgtagattcagtgttcacagtatgtggcctccagcatgtaacatgaggaatcctttatttcattaattaatggctttttgacttgagccaaaacatatgtaaaggaaacagaagtaccgcacctcctcttacaccagtcagctcctttgccttcagtgttactagaaagcggcctgtgtccatgagtgtgctttgctgttggtgcactgaaaggcaggaaggagacaagattttctatttactcatctcatgatgtcatttgaagggcatgtccagatatcttaaaattataataggctcaagaatcagtctcaggtcactttacccaaaaacatttgaaaatctgaaccacaatctcctgaaagtttttctcctatagattgttgacaacacattgttttctggaggcatttgtgccattaggtttccatttatcttcagtttttttctttggtgtttgggatgtcttattttgttgccttatgtccttttcaatttaaaatgtttgagtttgtatatagttttgaaattggattatgtgttcattgttgtttagtttgcatttttgtcaaattatggttttgaaggttcatttggaacttactgttagtctgtaacagggttgcccttgtccagtatttatttataagctgtttacttttcaagttgataaaaacattctccaattctaaatttgcttgtgtccataggtgatctctttagcaaactgagaaaaaaaggaagctacttttaacatgcaaagttccctcaaggtgtaccgtgttgtctctgtgggcactcttccccagcactttagcagtaattcccccagctacacgctgcagttgtactctgcccactctagtgttcctcagctctgctgtccttttacttgtagctggatctttgattatccttcgatttccatgaaatattaatattgttgccagcatagcaggtacagtggaagtcttgtagcagtgagattgtatcataatttaggatttaaaatgaattaaagtttatataaactgaagagtctccatatgtcaaactcttggaaaatcaaagatgttccaatttcctaaacactagagaatacgagagaaggtagagtggaaaaggttaggtaaccttgcaaaatattttactattttctctaaatatgaggaagtttgagattatgatctggatctaccagatataactaaggttaatttagcatgaaaaagttttagtcatattggcatccaacctattcagtaaccgaatcataggacaatgatggattaggagaacaatagagtgggatcattataaagaaaataaattattaaaggtgtctttatcgttttagtgccatttttagtgtctttactataaatcaatatcagtgtattttatcattctatgtgcatagcagaattttcttttctcccttttgttcccctgtgaacttggtgcttattaaagtgctcactgttctcttaaaagagagcagtggtataggtgtgcagtttccatgatgcaggttccatttttaatatattgttccacttatcctttcttctgagtaaattgctaattgtgccaaatttatgtaatagtttttgtaatgtggaataagaattatgatggaaccattgcacatttttttctgaaacagccagtcaaggcagaacattaatctccaaatgcaagggctgatctatttattcattttggaggttgggtactttattctttctttccgtcatccttttcattgtttcccccggattctaattagtttttattttttttagataactccaatataatcattacagtttatgctttaaatactatgtgctttaaaaaggaaaatgggaccaatttgtctgctaagaatttgattttaggtactataagagtattaggaaaatatatacaactggtgttaatttctagatattttctagaaatcacttgtgttcctatttaataaaaggtaatttagaatactacttgtcctttgcagtagtttagtaatgggcattaagctgtgtcctcgaaggatgtacctattactaggtgcattttagaatgaaatattgatattttattagcatataattgtggccatatatctcagattttctgaggcagatctaattttagataattctgttggtagaccatgtgatccttctttttggttttggaaatataatcattgttaatgttttccctccaaatagaatactgttttatccatacaaatcataacagcatctatcccatgctagggttggaaactgatattggtattacttgtgttttttcttagtgtgttttatttcccagtttcatcttcttctaaaaatgaaaatatggtgccttccctccctccaggaagactggcaaatatttccttttatttactgctgctgtggagtgatgagatatgcactttactctttaagattcagcaaaaagcttttcacttctcagtatatccagaatacatcatatctgggacttaggaaaatttgccaagcaatctttgtttttatagatactaatgttgaccctctccagcgttcaatgttataaatagaacaagtcaagctagtgtttatctcctccccctccccaaaactgtggcacagcatataaaaatgtacctcaataatgttctattaaaaatgggacaggggccttatgttttcataatttcccaacaatgtgccgccatatttttgcctcaaggtaaaggttttaacagatgaaaaagtacttcccaattcccccgtgctattcctaacctataatgcccaaatgttttgtgcaatgtgtagtgtgtgtgtataaatacatatattcttgaaatagacataccatcagagacatcattcacaagtaactgatgtattggcatctcattcatatttctgatgtgtgaggtatatggtactaattaccttttccttgatgtttgccaaatttgaataaaggcattggtacgaaattacagaatgtaaagaaaatgtttttggcttgaaaaattaacatattttatgacgtaccacagtatactctgcccaaaccagcaccctatctatctttcctgttctttacatccctgttccccatccctacttcctcatttttggtataacacagttcttttgtagcatcattataattgcagttctatggcaattggacagttatagcatggaaacagactggtataagtagtacagtagtcaccagtgtgccacatttgcattagtaatgcaaaatatacattttataaaggacaaactttgtgttatgttttattttcattacattgtataatattgtaagactattgtatgtcctaatttgcattataaatgtttttttcctacgtaaaggcataaatatagcaactttgtataaaggtagcttattagatttttaattttttcttttataaaaaattgtccaacagtgggactaccattgccaaattgtatatgaaatatgaattttacccccatggttaatttcttttataaacattccatatttctctaataaaaagacataagtgatactgtactatgcatacattgtatcttaatgctgtttcagatcagcattttaaattttggtttgcatttttaatattggcaaaacgtaaccactgttaattaaaataaaaccttgttgtatatgtaacaacataattttccctctatcccttcccaccctttgttctctatttctccctatcagtgccaacttcatacattttgtagcatggcaataaaatataacttttacactgaggccgagtgtggctttttggaggaagtggggatgggacgattgccctctagttgtcctttgcatatgactgttttttgccatataagccatgtcatcaggcatgaaaagttttctcatatatgatgtaaacttgcttttaaggacaagtgtgaatgtgctttttaagcttaatttttgtcatgacaactaattttttttatctttggagaagtcagagttctttacaatcaaacgtttattaactggagtacttagaataagctagtaattgaatttagttcaagggctaagcaacacatttttaaatccttatttattgtagagtattagtatactgtcctacaaattatgtaaaatatggtttaatattagatgactttggattttgcaatgccttactgttgtcattctagcataaatatccataatgaggtactcaagttgatactggaagctgagctgatcatacactgacctgaagcattcatgaaaagctgctttattgaataaagtctgattggagttcttttcatgctcactttccccttattgctgaaagtagattgcaataaaaccccaataaaacgtttggtcgg

SEQ ID NO: 2381 - DNA, 6653 bp, Homo sapiens
tattcaagagtaacattcttaataacttaacctatatttcagaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggcataatggaacttacagacacagaactgattttatacacccgcaaacgtgactcagtaaaatggcactacctctgcctgcgacgctatggctatgactcgaatctcttttcttttgaaagtggtcgaaggtgtcaaactggacaaggaatctttgcctttaagtgtgcccgtgcagaagaattatttaacatgttgcaagagattatgcaaaataatagtataaatgtggtggaagagccagttgtagaaagaaataatcatcagacagaattggaagtccctagaacacctcgaacacctacaactccaggatttgctgctcagaacttacctaatggatatccccgatatccctcatttggagatgcttcatcccatccgtcaagcagacatccttctgtgggaagtgctcgcctgccttcagtaggggaagaatctacacatcctttgcttgtggctgaggaacaagtacatacctatgtcaacactacaggtgtgcaagaagagcggaaaaaccgcacaagtgtgcatgttccattggaggcgagggtttctaacgctgaaagcagcacaccaaaagaagaaccaagtagtattgaggacagggatcctcagattcttcttgaacctgaaggagtcaaatttgttttagggccaacccctgttcaaaagcagttaatggaaaaagagaaactggagcaacttggaagagatcaagttagtggaagtggagcaaataacacagaatgggacactggctatgacagtgatgaacgaagagatgcaccctctgttaacaaactggtgtatgaaaatataaatgggctatctatccctagtgcctcaggggtcaggagaggtcgtctgacatccaccagtacctcagatacccagaatatcaacaactcagctcagagaagaactgcattattaaactatgaaaatctaccatctttgcctcctgtttgggaagcccgcaagctaagtagggatgaagatgacaatttaggaccaaagaccccatctctaaatggctaccataataatctagatccaatgcataactatgtaaatacagagaatgtaacagtgccagcaagtgctcacaaaatagaatattcaaggcgtcgggactgtacaccaacagtctttaactttgatatcagacgcccaagtttagaacacaggcagcttaattacatacaggttgacttggaaggtggcagtgactctgacaaccctcagactccaaaaacgcctacaactccccttccacaaacccctaccaggcgcacagagctgtatgccgtgatagacatcgagagaactgctgctatgtcaaatttgcagaaagcactgccacgagatgatggtacatctaggaaaactagacacaatagtactgatctgcccatgtgagcctggaaagcattgtgttgtttgcacctttgtgaagtttttaaaaatgaagatgcaagtgcttcattttcatttctaaacactaactccttttatagactgataaaatttttttctgaatatttcatgtgcatctttaactaaagggaattaatgtagagcaggtactccttaaagaacactaatttcattatatactactcgttgtacagcagcattcccgttttcacagtgcctatttaaaatgagagttgaagtaaatgacatgctggttgatttttatcaatattctggacttaacgcatacctttcatgtctaagtcatggttggcttttaaaactttttataaagcctcttgacaatgtacattgctaacaggtaactataggctttgaaagtaatgctcgtagattcagtgttcacagtatgtggcctccagcatgtaacatgaggaatcctttatttcattaattaatggctttttgacttgagccaaaacatatgtaaaggaaacagaagtaccgcacctcctcttacaccagtcagctcctttgccttcagtgttactagaaagcggcctgtgtccatgagtgtgctttgctgttggtgcactgaaaggcaggaaggagacaagattttctatttactcatctcatgatgtcatttgaagggcatgtccagatatcttaaaattataataggctcaagaatcagtctcaggtcactttacccaaaaacatttgaaaatctgaaccacaatctcctgaaagtttttctcctatagattgttgacaacacattgttttctggaggcatttgtgccattaggtttccatttatcttcagtttttttctttggtgtttgggatgtcttattttgttgccttatgtccttttcaatttaaaatgtttgagtttgtatatagttttgaaattggattatgtgttcattgttgtttagtttgcatttttgtcaaattatggttttgaaggttcatttggaacttactgttagtctgtaacagggttgcccttgtccagtatttatttataagctgtttacttttcaagttgataaaaacattctccaattctaaatttgcttgtgtccataggtgatctctttagcaaactgagaaaaaaaggaagctacttttaacatgcaaagttccctcaaggtgtaccgtgttgtctctgtgggcactcttccccagcactttagcagtaattcccccagctacacgctgcagttgtactctgcccactctagtgttcctcagctctgctgtccttttacttgtagctggatctttgattatccttcgatttccatgaaatattaatattgttgccagcatagcaggtacagtggaagtcttgtagcagtgagattgtatcataatttaggatttaaaatgaattaaagtttatataaactgaagagtctccatatgtcaaactcttggaaaatcaaagatgttccaatttcctaaacactagagaatacgagagaaggtagagtggaaaaggttaggtaaccttgcaaaatattttactattttctctaaatatgaggaagtttgagattatgatctggatctaccagatataactaaggttaatttagcatgaaaaagttttagtcatattggcatccaacctattcagtaaccgaatcataggacaatgatggattaggagaacaatagagtgggatcattataaagaaaataaattattaaaggtgtctttatcgttttagtgccatttttagtgtctttactataaatcaatatcagtgtattttatcattctatgtgcatagcagaattttcttttctcccttttgttcccctgtgaacttggtgcttattaaagtgctcactgttctcttaaaagagagcagtggtataggtgtgcagtttccatgatgcaggttccatttttaatatattgttccacttatcctttcttctgagtaaattgctaattgtgccaaatttatgtaatagtttttgtaatgtggaataagaattatgatggaaccattgcacatttttttctgaaacagccagtcaaggcagaacattaatctccaaatgcaagggctgatctatttattcattttggaggttgggtactttattctttctttccgtcatccttttcattgtttcccccggattctaattagtttttattttttttagataactccaatataatcattacagtttatgctttaaatactatgtgctttaaaaaggaaaatgggaccaatttgtctgctaagaatttgattttaggtactataagagtattaggaaaatatatacaactggtgttaatttctagatattttctagaaatcacttgtgttcctatttaataaaaggtaatttagaatactacttgtcctttgcagtagtttagtaatgggcattaagctgtgtcctcgaaggatgtacctattactaggtgcattttagaatgaaatattgatattttattagcatataattgtggccatatatctcagattttctgaggcagatctaattttagataattctgttggtagaccatgtgatccttctttttggttttggaaatataatcattgttaatgttttccctccaaatagaatactgttttatccatacaaatcataacagcatctatcccatgctagggttggaaactgatattggtattacttgtgttttttcttagtgtgttttatttcccagtttcatcttcttctaaaaatgaaaatatggtgccttccctccctccaggaagactggcaaatatttccttttatttactgctgctgtggagtgatgagatatgcactttactctttaagattcagcaaaaagcttttcacttctcagtatatccagaatacatcatatctgggacttaggaaaatttgccaagcaatctttgtttttatagatactaatgttgaccctctccagcgttcaatgttataaatagaacaagtcaagctagtgtttatctcctccccctccccaaaactgtggcacagcatataaaaatgtacctcaataatgttctattaaaaatgggacaggggccttatgttttcataatttcccaacaatgtgccgccatatttttgcctcaaggtaaaggttttaacagatgaaaaagtacttcccaattcccccgtgctattcctaacctataatgcccaaatgttttgtgcaatgtgtagtgtgtgtgtataaatacatatattcttgaaatagacataccatcagagacatcattcacaagtaactgatgtattggcatctcattcatatttctgatgtgtgaggtatatggtactaattaccttttccttgatgtttgccaaatttgaataaaggcattggtacgaaattacagaatgtaaagaaaatgtttttggcttgaaaaattaacatattttatgacgtaccacagtatactctgcccaaaccagcaccctatctatctttcctgttctttacatccctgttccccatccctacttcctcatttttggtataacacagttcttttgtagcatcattataattgcagttctatggcaattggacagttatagcatggaaacagactggtataagtagtacagtagtcaccagtgtgccacatttgcattagtaatgcaaaatatacattttataaaggacaaactttgtgttatgttttattttcattacattgtataatattgtaagactattgtatgtcctaatttgcattataaatgtttttttcctacgtaaaggcataaatatagcaactttgtataaaggtagcttattagatttttaattttttcttttataaaaaattgtccaacagtgggactaccattgccaaattgtatatgaaatatgaattttacccccatggttaatttcttttataaacattccatatttctctaataaaaagacataagtgatactgtactatgcatacattgtatcttaatgctgtttcagatcagcattttaaattttggtttgcatttttaatattggcaaaacgtaaccactgttaattaaaataaaaccttgttgtatatgtaacaacataattttccctctatcccttcccaccctttgttctctatttctccctatcagtgccaacttcatacattttgtagcatggcaataaaatataacttttacactgaggccgagtgtggctttttggaggaagtggggatgggacgattgccctctagttgtcctttgcatatgactgttttttgccatataagccatgtcatcaggcatgaaaagttttctcatatatgatgtaaacttgcttttaaggacaagtgtgaatgtgctttttaagcttaatttttgtcatgacaactaattttttttatctttggagaagtcagagttctttacaatcaaacgtttattaactggagtacttagaataagctagtaattgaatttagttcaagggctaagcaacacatttttaaatccttatttattgtagagtattagtatactgtcctacaaattatgtaaaatatggtttaatattagatgactttggattttgcaatgccttactgttgtcattctagcataaatatccataatgaggtactcaagttgatactggaagctgagctgatcatacactgacctgaagcattcatgaaaagctgctttattgaataaagtctgattggagttcttttcatgctcactttccccttattgctgaaagtagattgcaataaaaccccaataaaacgtttggtcgg

SEQ ID NO: 2382 - DNA, 611 bp, Homo sapiens
aaaacccttccctcccccgctcccccggaagtgcttttccaagattcgggccggagagaggccttgtaggcacagcggctgagactcgatctgctccaagtaggggctccagcgcgggtcggagtctgggggttcgcgcccgccgacccgcgccctgctccctctcagcacctgggcggacgctcctggcaaccactatttgagtttctgcctctacaaatttgactattctaggtacttcataaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggc

SEQ ID NO: 2383 - DNA, 597 bp, Homo sapiens
ttttccaagattcgggccggagagaggccttgtaggcacagcggctgagactcgatctgctccaagtaggggctccagcgcgggtcggagtctgggggttcgcgcccgccgacccgcgccctgctccctctcagcacctgggcggacgaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggagattttcttctttctaccatcatcaagatcaagcaggcaagtttacttgctgtcatcttctgcaaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggcataatggaactta

SEQ ID NO: 2384 - DNA, 584 bp, Homo sapiens
acagcggctgagactcgatctgctccaagtaggggctccagcgcgggtcggagtctgggggttcgcgcccgccgacccgcgccctgctccctctcagcacctgggcggacggtacccaggctgaagtgcagtgtcacaatcatagctcaccacggtcttgaactcctgggctcaagcgatcattctgactcagcctcccaagtaggtaggaccacaggtgtacagaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagtta

SEQ ID NO: 2385 - DNA, 1952 bp, Homo sapiens
ggaagtgcttttccaagattcgggccggagagaggccttgtaggcacagcggctgagactcgatctgctccaagtaggggctccagcgcgggtcggagtctgggggttcgcgcccgccgacccgcgccctgctccctctcagcacctgggcggacgaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggcataatggaacttacagacacagaactgattttatacacccgcaaacgtgactcagtaaaatggcactacctctgcctgcgacgctatggctatgactcgaatctcttttcttttgaaagtggtcgaaggtgtcaaactggacaaggaatctttgcctttaagtgtgcccgtgcagaagaattatttaacatgttgcaagagattatgcaaaataatagtataaatgtggtggaagagccagttgtagaaagaaataatcatcagacagaattggaagtccctagaacacctcgaacacctacaactccaggatttgctgctcagaacttacctaatggatatccccgatatccctcatttggagatgcttcatcccatccgtcaagcagacatccttctgtgggaagtgctcgcctgccttcagtaggggaagaatctacacatcctttgcttgtggctgaggaacaagtacatacctatgtcaacactacaggtgtgcaagaagagcggaaaaaccgcacaagtgtgcatgttccattggaggcgagggtttctaacgctgaaagcagcacaccaaaagaagaaccaagtagtattgaggacagggatcctcagattcttcttgaacctgaaggagtcaaatttgttttagggccaacccctgttcaaaagcagttaatggaaaaagagaaactggagcaacttggaagagatcaagttagtggaagtggagcaaataacacagaatgggacactggctatgacagtgatgaacgaagagatgcaccctctgttaacaaactggtgtatgaaaatataaatgggctatctatccctagtgcctcaggggtcaggagaggtcgtctgacatccaccagtacctcagatacccagaatatcaacaactcagctcagagaagaactgcattattaaactatgaaaatctaccatctttgcctcctgtttgggaagcccgcaagctaagtagggatgaagatgacaatttaggaccaaagaccccatctctaaatggctaccataataatctagatccaatgcataactatgtaaatacagagaatgtaacagtgccagcaagtgctcacaaaatagaatattcaaggcgtcgggactgtacaccaacagtctttaactttgatatcagacgcccaagtttagaacacaggcagcttaattacatacaggttgacttggaaggtggcagtgactctgacaaccctcagactccaaaaacgcctacaactccccttccacaaacccctaccaggcgcacagagctgtatgccgtgatagacatcgagagaactgctgctatgtcaaatttgcagaaagcactgccacgagatgatggtacatctaggaaaactagacacaatagtactgatctgcccatgtgagcctggaaa

SEQ ID NO: 2386 - DNA, 570 bp, Homo sapiens
tcgatctgctccaagtaggggctccagcgcgggtcggagtctgggggttcgcgcccgccgacccgcgccctgctccctctcagcacctgggcggacggtacccaggctgaagtgcagtgtcacaatcatagctcaccacggtcttgaactcctgggctcaagcgatcattctgactcagcctcccaagtaggtaggaccacaggtgtacagaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggagattttcttctttctaccatcatcaagatcaagcaggcaagtttacttgctgtcatcttctgcaaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaag

SEQ ID NO: 2387 - DNA, 545 bp, Homo sapiens
agtgcttttccaagattcgggccggagagaggccttgtaggcacagcggctgagactcgatctgctccaagtaggggctccagcgcgggtcggagtctgggggttcgcgcccgccgacccgcgccctgctccctctcagcacctgggcggacgattgaaggtttgtggcaaccctgtattcagaattctgtatcagtgccatttttccagccagcgtgtgcttacttcatgtctctgggtcacattttgaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacact

SEQ ID NO: 2388 - DNA, 6600 bp, Homo sapiens
gaggccttgtaggcacagcggctgagactcgatctgctccaagtaggggctccagcgcgggtcggagtctgggggttcgcgcccgccgacccgcgccctgctccctctcagcacctgggcggacggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggcataatggaacttacagacacagaactgattttatacacccgcaaacgtgactcagtaaaatggcactacctctgcctgcgacgctatggctatgactcgaatctcttttcttttgaaagtggtcgaaggtgtcaaactggacaaggaatctttgcctttaagtgtgcccgtgcagaagaattatttaacatgttgcaagagattatgcaaaataatagtataaatgtggtggaagagccagttgtagaaagaaataatcatcagacagaattggaagtccctagaacacctcgaacacctacaactccaggatttgctgctcagaacttacctaatggatatccccgatatccctcatttggagatgcttcatcccatccgtcaagcagacatccttctgtgggaagtgctcgcctgccttcagtaggggaagaatctacacatcctttgcttgtggctgaggaacaagtacatacctatgtcaacactacaggtgtgcaagaagagcggaaaaaccgcacaagtgtgcatgttccattggaggcgagggtttctaacgctgaaagcagcacaccaaaagaagaaccaagtagtattgaggacagggatcctcagattcttcttgaacctgaaggagtcaaatttgttttagggccaacccctgttcaaaagcagttaatggaaaaagagaaactggagcaacttggaagagatcaagttagtggaagtggagcaaataacacagaatgggacactggctatgacagtgatgaacgaagagatgcaccctctgttaacaaactggtgtatgaaaatataaatgggctatctatccctagtgcctcaggggtcaggagaggtcgtctgacatccaccagtacctcagatacccagaatatcaacaactcagctcagagaagaactgcattattaaactatgaaaatctaccatctttgcctcctgtttgggaagcccgcaagctaagtagggatgaagatgacaatttaggaccaaagaccccatctctaaatggctaccataataatctagatccaatgcataactatgtaaatacagagaatgtaacagtgccagcaagtgctcacaaaatagaatattcaaggcgtcgggactgtacaccaacagtctttaactttgatatcagacgcccaagtttagaacacaggcagcttaattacatacaggttgacttggaaggtggcagtgactctgacaaccctcagactccaaaaacgcctacaactccccttccacaaacccctaccaggcgcacagagctgtatgccgtgatagacatcgagagaactgctgctatgtcaaatttgcagaaagcactgccacgagatgatggtacatctaggaaaactagacacaatagtactgatctgcccatgtgagcctggaaagcattgtgttgtttgcacctttgtgaagtttttaaaaatgaagatgcaagtgcttcattttcatttctaaacactaactccttttatagactgataaaatttttttctgaatatttcatgtgcatctttaactaaagggaattaatgtagagcaggtactccttaaagaacactaatttcattatatactactcgttgtacagcagcattcccgttttcacagtgcctatttaaaatgagagttgaagtaaatgacatgctggttgatttttatcaatattctggacttaacgcatacctttcatgtctaagtcatggttggcttttaaaactttttataaagcctcttgacaatgtacattgctaacaggtaactataggctttgaaagtaatgctcgtagattcagtgttcacagtatgtggcctccagcatgtaacatgaggaatcctttatttcattaattaatggctttttgacttgagccaaaacatatgtaaaggaaacagaagtaccgcacctcctcttacaccagtcagctcctttgccttcagtgttactagaaagcggcctgtgtccatgagtgtgctttgctgttggtgcactgaaaggcaggaaggagacaagattttctatttactcatctcatgatgtcatttgaagggcatgtccagatatcttaaaattataataggctcaagaatcagtctcaggtcactttacccaaaaacatttgaaaatctgaaccacaatctcctgaaagtttttctcctatagattgttgacaacacattgttttctggaggcatttgtgccattaggtttccatttatcttcagtttttttctttggtgtttgggatgtcttattttgttgccttatgtccttttcaatttaaaatgtttgagtttgtatatagttttgaaattggattatgtgttcattgttgtttagtttgcatttttgtcaaattatggttttgaaggttcatttggaacttactgttagtctgtaacagggttgcccttgtccagtatttatttataagctgtttacttttcaagttgataaaaacattctccaattctaaatttgcttgtgtccataggtgatctctttagcaaactgagaaaaaaaggaagctacttttaacatgcaaagttccctcaaggtgtaccgtgttgtctctgtgggcactcttccccagcactttagcagtaattcccccagctacacgctgcagttgtactctgcccactctagtgttcctcagctctgctgtccttttacttgtagctggatctttgattatccttcgatttccatgaaatattaatattgttgccagcatagcaggtacagtggaagtcttgtagcagtgagattgtatcataatttaggatttaaaatgaattaaagtttatataaactgaagagtctccatatgtcaaactcttggaaaatcaaagatgttccaatttcctaaacactagagaatacgagagaaggtagagtggaaaaggttaggtaaccttgcaaaatattttactattttctctaaatatgaggaagtttgagattatgatctggatctaccagatataactaaggttaatttagcatgaaaaagttttagtcatattggcatccaacctattcagtaaccgaatcataggacaatgatggattaggagaacaatagagtgggatcattataaagaaaataaattattaaaggtgtctttatcgttttagtgccatttttagtgtctttactataaatcaatatcagtgtattttatcattctatgtgcatagcagaattttcttttctcccttttgttcccctgtgaacttggtgcttattaaagtgctcactgttctcttaaaagagagcagtggtataggtgtgcagtttccatgatgcaggttccatttttaatatattgttccacttatcctttcttctgagtaaattgctaattgtgccaaatttatgtaatagtttttgtaatgtggaataagaattatgatggaaccattgcacatttttttctgaaacagccagtcaaggcagaacattaatctccaaatgcaagggctgatctatttattcattttggaggttgggtactttattctttctttccgtcatccttttcattgtttcccccggattctaattagtttttattttttttagataactccaatataatcattacagtttatgctttaaatactatgtgctttaaaaaggaaaatgggaccaatttgtctgctaagaatttgattttaggtactataagagtattaggaaaatatatacaactggtgttaatttctagatattttctagaaatcacttgtgttcctatttaataaaaggtaatttagaatactacttgtcctttgcagtagtttagtaatgggcattaagctgtgtcctcgaaggatgtacctattactaggtgcattttagaatgaaatattgatattttattagcatataattgtggccatatatctcagattttctgaggcagatctaattttagataattctgttggtagaccatgtgatccttctttttggttttggaaatataatcattgttaatgttttccctccaaatagaatactgttttatccatacaaatcataacagcatctatcccatgctagggttggaaactgatattggtattacttgtgttttttcttagtgtgttttatttcccagtttcatcttcttctaaaaatgaaaatatggtgccttccctccctccaggaagactggcaaatatttccttttatttactgctgctgtggagtgatgagatatgcactttactctttaagattcagcaaaaagcttttcacttctcagtatatccagaatacatcatatctgggacttaggaaaatttgccaagcaatctttgtttttatagatactaatgttgaccctctccagcgttcaatgttataaatagaacaagtcaagctagtgtttatctcctccccctccccaaaactgtggcacagcatataaaaatgtacctcaataatgttctattaaaaatgggacaggggccttatgttttcataatttcccaacaatgtgccgccatatttttgcctcaaggtaaaggttttaacagatgaaaaagtacttcccaattcccccgtgctattcctaacctataatgcccaaatgttttgtgcaatgtgtagtgtgtgtgtataaatacatatattcttgaaatagacataccatcagagacatcattcacaagtaactgatgtattggcatctcattcatatttctgatgtgtgaggtatatggtactaattaccttttccttgatgtttgccaaatttgaataaaggcattggtacgaaattacagaatgtaaagaaaatgtttttggcttgaaaaattaacatattttatgacgtaccacagtatactctgcccaaaccagcaccctatctatctttcctgttctttacatccctgttccccatccctacttcctcatttttggtataacacagttcttttgtagcatcattataattgcagttctatggcaattggacagttatagcatggaaacagactggtataagtagtacagtagtcaccagtgtgccacatttgcattagtaatgcaaaatatacattttataaaggacaaactttgtgttatgttttattttcattacattgtataatattgtaagactattgtatgtcctaatttgcattataaatgtttttttcctacgtaaaggcataaatatagcaactttgtataaaggtagcttattagatttttaattttttcttttataaaaaattgtccaacagtgggactaccattgccaaattgtatatgaaatatgaattttacccccatggttaatttcttttataaacattccatatttctctaataaaaagacataagtgatactgtactatgcatacattgtatcttaatgctgtttcagatcagcattttaaattttggtttgcatttttaatattggcaaaacgtaaccactgttaattaaaataaaaccttgttgtatatgtaacaacataattttccctctatcccttcccaccctttgttctctatttctccctatcagtgccaacttcatacattttgtagcatggcaataaaatataacttttacactgaggccgagtgtggctttttggaggaagtggggatgggacgattgccctctagttgtcctttgcatatgactgttttttgccatataagccatgtcatcaggcatgaaaagttttctcatatatgatgtaaacttgcttttaaggacaagtgtgaatgtgctttttaagcttaatttttgtcatgacaactaattttttttatctttggagaagtcagagttctttacaatcaaacgtttattaactggagtacttagaataagctagtaattgaatttagttcaagggctaagcaacacatttttaaatccttatttattgtagagtattagtatactgtcctacaaattatgtaaaatatggtttaatattagatgactttggattttgcaatgccttactgttgtcattctagcataaatatccataatgaggtactcaagttgatactggaagctgagctgatcatacactgacctgaagcattcatgaaaagctgctttattgaataaagtctgattggagttcttttcatgctcactttccccttattgctgaaagtagattgcaataaaaccccaataaaacgtttggtcggata

SEQ ID NO: 2389 - DNA, 781 bp, Homo sapiens
ggccttgtaggcacagcggctgagactcgatctgctccaagtaggggctccagcgcgggtcggagtctgggggttcgcgcccgccgacccgcgccctgctccctctcagcacctgggcggacgaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggagattttcttctttctaccatcatcaagatcaagcaggcaagtttacttgctgtcatcttctgcaagatacgtaccaagattaacaatgactccaggatagagttatgaccaacactactaaaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggcataatggaacttacagacacagaactgattttatacacccgcaaacgtgactcagtaaaatggcactacctctgcctgcgacgctatggctatgactcgaatctcttttcttttgaaagtggtcgaaggtgtcaaactggacaaggaatctttgcctttaagtgt

SEQ ID NO: 2390 - DNA, 704 bp, Homo sapiens
agaaattctcaatgtttttcttctgtttttaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggcataatggaacttacagacacagaactgattttatacacccgcaaacgtgactcagtaaaatggcactacctctgcctgcgacgctatggctatgactcgaatctcttttcttttgaaagtggtcgaaggtgtcaaactggacaaggaatctttgcctttaagtgtgcccgtgcagaagaattatttaacatgttgcaagagattatgcaaaataatagtataaatgtggtggaagagccagttgtagaaagaaataatcatcagacagaattggaagtccctagaacacctcgaacacctacaactccaggatttgctgctcagaacttacctaatggatatccccgatatccctcatttggagatgcttcatcccatccgtcaagcagacatccttctgtgggaagtgctcgcctgccttcagtaggggaagaatctacaca

SEQ ID NO: 2391 - DNA, 2094 bp, Homo sapiens
gctaggtgagccccaggtgtatcccagagggatccgggtgacttctctgcagactgtttgccatgacagcccaccaaggacggggggaataaagtgggaacccttccccatgcccctcccacggtcagctccccgatggcctgggtgagggcaggctggctgctctgacaccatggggagctgctgcagctgcctgaacagagacagcgttccagacaaccaccccaccaagttcaaggtgacaaatgtggatgatgagggggtggagctgggctctggggtgatggagctgacgcagagtgagctggtgctgcacctgcatcggcgtgaggccgtccgctggccttatctctgcttgcggcgctatggctacgactccaacctcttctcctttgagagtggccgccgatgtcagacaggccagggaatatttgcatttaagtgttcccgggctgaggaaatcttcaacctccttcaggatctgatgcagtgcaacagcatcaatgtgatggaagagcctgtcatcatcacccgcaatagccaccccgctgagcttgacctccctcgagccccccagccacccaatgctctaggctacactgtctccagcttttccaatggctgccctggagagggcccacgattctcagctccccggcggctctcgacaagcagcctgcggcacccctcgcttggggaagagtccacccatgccctcattgctcctgatgagcagtcccacacctatgtcaacacaccggccagtgaagatgaccaccgcaggggccgccactgcctgcagcccctgcctgagggtcaggcacccttcctcccgcaggcccggggacctgaccaacgggacccacaggtgttcttgcagccaggccaggtgaagtttgtgttgggcccgacccctgctcggcggcacatggtgaagtgccagggcctctgtcccagcctgcatgaccccccacaccacaataataacaatgaggccccttctgagtgtccagcccagcccaagtgcacctacgagaacgtcaccggggggctgtggcgaggggctggctggagactgagcccagaggagccgggctggaatggccttgcccaccgccgggccgccctgctgcactatgagaacctgcccccactgccccctgtgtgggaaagccaagcccagcagctgggaggggaggctggggatgatggggactcgagggatgggctcacaccctcttccaatggcttccctgatggtgaggaggacgagaccccactgcagaagcccaccagcacccgggccgccatccgcagccacggcagctttcctgtgccactgacccgccgccgcggctccccaagggtcttcaactttgatttccgccggccggggcccgagcccccaaggcagcttaactacatccaggtggagctaaagggctggggtggagaccgccctaaggggccccagaacccctcgagcccccaagcccccatgcccaccacccaccctgcccgaagctcagactcctacgccgtgattgacctcaaaaagaccgtggccatgtccaacctgcagagagctctgccccgagacgatggcaccgccaggaaaacccggcacaacagcaccgacctgcctctgtagggacttcccggtcctcaccaccctctgccccaccatgatccagcctctgcctcacactcctgtcctctgaacccaccctccccagggttcagggttgctttgcagaaggcatggaggtgggaccagatgcttccctgtgctggctggagtccccagagatatcagccaccgagtctcctggtctgtctccaggctggggagagaagggtgaccaggcgaggagggagccgagacgtcaactgtgaagggttcctgtgattgcgtttagcgccctcccgttctgtccatttgtcttgtctgccgactgtccgtgtgtgttttttttggttggaattttgaaacattttgtacctgttgattttatttatcagtttatttttctatttattgttttaaatgtaatttaacatatttattattaatataattatttttaaattctg

SEQ ID NO: 2392 - DNA, 2174 bp, Homo sapiens
ggggaggccttagctccgggcgggcggcggctgctgcagcgggacccgggagcggggcccggcgccgcccgggccgcggggcgatgtgagccccaggtgtatcccagagggatccgggtgacttctctgcagactgtttgccatgacagcccaccaaggacggggggaataaagtgggaacccttccccatgcccctcccacggtcagctccccgatggcctgggtgagggcaggctggctgctctgacaccatggggagctgctgcagctgcctgaacagagacagcgttccagacaaccaccccaccaagttcaaggtgacaaatgtggatgatgagggggtggagctgggctctggggtgatggagctgacgcagagtgagctggtgctgcacctgcatcggcgtgaggccgtccgctggccttatctctgcttgcggcgctatggctacgactccaacctcttctcctttgagagtggccgccgatgtcagacaggccagggaatatttgcatttaagtgttcccgggctgaggaaatcttcaacctccttcaggatctgatgcagtgcaacagcatcaatgtgatggaagagcctgtcatcatcacccgcaatagccaccccgctgagcttgacctccctcgagccccccagccacccaatgctctaggctacactgtctccagcttttccaatggctgccctggagagggcccacgattctcagctccccggcggctctcgacaagcagcctgcggcacccctcgcttggggaagagtccacccatgccctcattgctcctgatgagcagtcccacacctatgtcaacacaccggccagtgaagatgaccaccgcaggggccgccactgcctgcagcccctgcctgagggtcaggcacccttcctcccgcaggcccggggacctgaccaacgggacccacaggtgttcttgcagccaggccaggtgaagtttgtgttgggcccgacccctgctcggcggcacatggtgaagtgccagggcctctgtcccagcctgcatgaccccccacaccacaataataacaatgaggccccttctgagtgtccagcccagcccaagtgcacctacgagaacgtcaccggggggctgtggcgaggggctggctggagactgagcccagaggagccgggctggaatggccttgcccaccgccgggccgccctgctgcactatgagaacctgcccccactgccccctgtgtgggaaagccaagcccagcagctgggaggggaggctggggatgatggggactcgagggatgggctcacaccctcttccaatggcttccctgatggtgaggaggacgagaccccactgcagaagcccaccagcacccgggccgccatccgcagccacggcagctttcctgtgccactgacccgccgccgcggctccccaagggtcttcaactttgatttccgccggccggggcccgagcccccaaggcagcttaactacatccaggtggagctaaagggctggggtggagaccgccctaaggggccccagaacccctcgagcccccaagcccccatgcccaccacccaccctgcccgaagctcagactcctacgccgtgattgacctcaaaaagaccgtggccatgtccaacctgcagagagctctgccccgagacgatggcaccgccaggaaaacccggcacaacagcaccgacctgcctctgtagggacttcccggtcctcaccaccctctgccccaccatgatccagcctctgcctcacactcctgtcctctgaacccaccctccccagggttcagggttgctttgcagaaggcatggaggtgggaccagatgcttccctgtgctggctggagtccccagagatatcagccaccgagtctcctggtctgtctccaggctggggagagaagggtgaccaggcgaggagggagccgagacgtcaactgtgaagggttcctgtgattgcgtttagcgccctcccgttctgtccatttgtcttgtctgccgactgtccgtgtgtgttttttttggttggaattttgaaacattttgtacctgttgattttatttatcagtttatttttctatttattgttttaaatgtaatttaacatatttattattaatataattatttttaaattctg

SEQ ID NO: 2393 - DNA, 326 bp, Homo sapiens
cgcggggtgggttcgggcggcccttggaacgctccggccagggatgcgcggtgagccccaggtgtatcccagagggatccgggtgacttctctgcagactgtttgccatgacagcccaccaaggacggggggaataaagtgggaacccttccccatgcccctcccacggtcagctccccgatggcctgggtgagggcaggctggctgctctgacaccatggggagctgctgcagctgcctgaacagagacagcgttccagacaaccaccccaccaagttcaaggtgacaaatgtggatgatgagggggtggagctgggctctgggg

SEQ ID NO: 2394 - DNA, 474 bp, Homo sapiens
cgcgtttacgctgggttttcaaccattcgctgaatggaaacgcctcgccgggcccgcagccctgtctctccgcagttcccagggcaggctggctgctctgacaccatggggagctgctgcagctgcctgaacagagacagcgttccagacaaccaccccaccaagttcaaggtgacaaatgtggatgatgagggggtggagctgggctctggggtgatggagctgacgcagagtgagctggtgctgcacctgcatcggcgtgaggccgtccgctggccttatctctgcttgcggcgctatggctacgactccaacctcttctcctttgagagtggccgccgatgtcagacaggccagggaatatttgcatttaagtgttcccgggctgaggaaatcttcaacctccttcaggatctgatgcagtgcaacagcatcaatgtgatggaagagcctgtcatcatcacccgcaatagc

SEQ ID NO: 2395 - DNA, 6161 bp, Homo sapiens
gagttaaccacctgttcagtcgggaggtggactcgaggctgcagtcctcgcccggttttaacaacctggatcttcgaacttttgacacggctttggaaacgacgtcatgtgttagaattggagcgttattcagtatattaatgtcttattgataatggcagaacatccaccactactggatacaactcagatcttaagtagtgatatttctcttttgtctgcccctattgtaagtgcagatggaacacaacaggttcccctgggaagtgccagtcttacaacataaactaacaggaagggtaatgctttaagtgtacaggcctagtttctttttgggagaacctacagcaggatgtgaacattctgtgccaagcctccaggggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctatggagatgtagatgctcactctacacatggaaggtccaactttagagatgaacgatctagtaaaacatatgaacgtttgcagaaaaaattgaaggatcgccaaggaacacagaaagataaaatgagcagtccaccatcatcaccccagaaatgcccttctcccattaatgaacataatggacttataaaaggacaaattgctggtggtataaacacaggatcagcaaaaatcaagtctgggaaggggaaaggtggtacacaagttgatacagaaattgaagaaaaagatgaagaaactaaagcatttgaagcacttctttccaacattgtcaaaccagtggcctccgacatccaggcaaggacagtagtacttacctggtcaccaccttccagcctcattaatggtgaaacagatgaaagtagtgtaccagagctctatggttatgaagttctgatctcaagtactggaaaagatgggaaatacaaaagtgtatatgtaggagaagaaacaaatatcactttaaatgatctcaagccagccatggattaccatgcaaaagtccaggcagaatataattctataaagggaactccttcagaggctgaaatctttaccaccttgagctgtgaacctgatatacctaatccaccaaggatagccaatcggaccaaaaattcactcactttgcaatggaaggcacctagtgacaatggttctaaaatccaaaactttgtattagaatgggatgaaggaaaaggaaatggagaattttgtcagtgttacatgggctcacagaaacaatttaaaattactaaactttcaccagcaatgggctgtaaattcagactatcggccagaaatgactatggtacaagtggttttagtgaagaagtcttatattacacctcaggctgtgctccttctatgccagcaagtcctgtattaaccaaggctggaattacttggttatccttacaatggagtaagccctcaggaacaccatcagatgaaggaatttcttacattttagagatggaggaagaaacttcaggatatggttttaagcctaaatatgatggagaagatcttgcttacacagtgaaaaatctcagacgtagtactaagtataaatttaaggttattgcttacaactcagaaggtaaaagtaatccaagtgaagtagtagaatttactacttgccctgataaaccaggcatacctgtaaagccttcagtgaaaggaaagatacattcacacagttttaaaataacctgggatccaccaaaagacaatggcggagcaaccatcaataaatatgtagtggagatggcagaaggttctaacggaaacaaatgggaaatgatatacagtggtgctaccagggaacatctttgtgatcgactgaatccaggctgtttctatcgtttacgagtttactgcatcagtgatggaggacagagtgcggtctctgaatctttacttgtgcagactccagctgtgcctcctggcccatgcctccctcccagattacagggtagacccaaagcaaaagaaatacagttacgatggggaccccctctggttgatggtggatcacccatttcctgttacagtgtggaaatgtctcctatagaaaaagatgaacctagagaagtttaccaaggttctgaagtagaatgtacagtgagcagccttcttcctggaaagacatacagcttcagactacgtgcagctaacaaaatggggtttggaccattttcagaaaaatgtgatattactacagcccctgggccaccagatcagtgcaagccccctcaagtgacatgtagatctgcaacttgtgcacaagtgaattgggaggttcctttgagtaatggaacagatgtcactgaatatcgactggagtggggaggagttgaaggaagtatgcagatatgttactgtgggcctggtctcagttatgaaataaaaggactttcaccagcaactacctattattgcagggtccaggctctgagtgttgtgggtgcaggccctttcagtgaagtagtagcctgtgtgactccaccatcagttcctggcattgtgacctgtcttcaagaaataagcgatgatgagatagaaaatccccattattcaccttctacatgccttgcaataagctgggaaaagccttgtgatcatggttcggaaatccttgcctacagcatagactttggagataaacaatccctaacagtgggaaaggttacaagctatattatcaacaatttgcaaccagatacaacatacagaatacgaattcaagccttgaatagccttggagctggtcctttcagccatatgataaaattaaaaactaagcctctccctcctgatccacctcgtctggaatgtgttgcctttagccaccagaaccttaagctgaaatggggagaaggaactccaaagacattgtcaaccgattctattcagtaccaccttcagatggaggataagaatggacggtttgtatccctatacagaggaccatgtcatacatacaaagtacaaagacttaatgagtcaacatcctataaattctgtattcaagcttgtaatgaagctggggaaggtcccctctcccaagaatatattttcactactccaaaatctgtcccagctgccttgaaagcccccaaaatagagaaagtaaatgatcacatttgtgaaattacatgggagtgtttacagccaatgaaaggtgatccagttatttacagtcttcaagttatgttgggaaaagattcagaattcaaacagatttacaagggtcccgactcttccttccggtattccagccttcagctgaactgtgaatatcgcttccgtgtatgtgccattcgccagtgccaagactctctgggacaccaggacctcgtaggtccctacagcaccacagtgctcttcatctctcagaggactgaaccaccagccagcaccaacagagacactgtggaaagcacaaggacccgacgggcactgagtgacgagcagtgtgctgccgtcatccttgtgctgtttgctttcttttccattttgattgcctttatcattcagtactttgtaatcaagtgaaaatataactttattttttaactctattacattttattttgtcatgtactaaaattatttctgtattgcttttataaaaaacagtggcatttagcactggcattgagactatagcacatcatttttgccattttcagtgcttatattgttaggtagaggctggcactttattagaatgcaagccacaaaaatatcaattttgttttttttgttagggtgggtcttctttttttctttccctctctctttttttaacaaatgccttcttatagaaaaactttctaagaggcaacaatttagaatggatattttgacgaatcggcatgagtgtaacagtgataacctgatctgtttgttttaaagattattaccaagtgaaaaattcagaatgaatagaatttacactaacatgctatataaaatgttaaagtctgatgctgtgaaagcaatctagtgctatatttctacctcctcatttgtcttaattatttggtaagtgggattatgatgagtaactggaggggcttagaaacaaaaactggatgaaagagtatgcatgaagaaaagcttctttgataaatgtggagttcttcattataaatatatattcatgaattcacagataagtacttaaagaacagacagtttacttggcctaaaaatattttgatgtttactcaaaaagtacctcttcaggtcttgagaacatggaaaagaattgagtgcttttaaatactttttagaaagtaatcataaaagtaaattgaatttcaaacctatttggcttctgttttgtgaacctttgaactatatgtatgtgtataagggtatacacatacatatatggcatataacaagtgtacacatatacacataacaagtgtagaagtatatattacatacatacactcactctgtctggtataggctaattttgaagaactcccataagtttctgctgcttctcccataactgctgccaccaccatcagaattcataatcaaacctaacctttttgtttggggcaccaaatctgaagacaaaattaatttgcaccagtaaacttcaagctgctttctttcttgaaaactaaacgtttaacgtataatgtctgtttggatactgttccaaattgttgattgcatgtggttaatgttgcattagagcactttgcaattgcataattcattaatgttttgtgagcttgcatttgtgagttattggatgatcagactgaattttgtcaagtatcacattgtacatcttgcctagatgtcgatgactgcaagtaataatacagtttataatgaaactatctacaattcttgttttagcacatctgttatccgtaaaacacctgtaactagcttttttaatttattatttgaattttaggatagcgaatcactaatttttagttgctgaggttggcattttagtgattattaagcacttctgtcagtctttgaaaaaagaacgtattttttgtgctttgaagatctctgaagaatttcttttataatagaatgggcatgtattgtaacagttttatgtcaaatgatctgtgctgtagaaaaacattaacccttgttcaaaaaagaaatggataaacttggcctttctaagtggtaagaatgacctgtcactataatatactgtatgtttacattttatttaaatttaatctcttatgtatagggtgataaccttccccagaaacaacagtgattgcgattgttttctagaaacttctttaaagtgccacatttggcagtacaaatgagtctgagtgtaatagcccagagatttatatatagttgaatgtctaaaatggtaaaatgtgccactgtgtcaagttacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaactttttaaagattatagatacactaccaaacatatcaccttaaaattgtataaggctgaatgaacttcatacaaatgaaaaaaatctcataaaaatacataaactatgtagcaaaagtatctgtaaaatccatggaaaataaaagttgtatcattctttttgagatacgtttattgtattcatatatattcattatttgctacctgtttaagaaagtgaaatgttatggtctcccctcttccaatgagcttaaaacatttttcccaacagtatataaatcttcaacatgagaggatgtatatttattatataaagcccagta

SEQ ID NO: 2396 - DNA, 5714 bp, Homo sapiens
agccgttctccaattaaagctgttaacgtgtactacgctgtttccttgttggattttcttgttctctgctgctactgtaaaaacgaaatgagtggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctatggagatgtagatgctcactctacacatggaaggtccaactttagagatgaacgatctagtaaaacatatgaacgtttgcagaaaaaattgaaggatcgccaaggaacacagaaagataaaatgagcagtccaccatcatcaccccagaaatgcccttctcccattaatgaacataatggacttataaaaggacaaattgctggtggtataaacacaggatcagcaaaaatcaagtctgggaaggggaaaggtggtacacaagttgatacagaaattgaagaaaaagatgaagaaactaaagcatttgaagcacttctttccaacattgtcaaaccagtggcctccgacatccaggcaaggacagtagtacttacctggtcaccaccttccagcctcattaatggtgaaacagatgaaagtagtgtaccagagctctatggttatgaagttctgatctcaagtactggaaaagatgggaaatacaaaagtgtatatgtaggagaagaaacaaatatcactttaaatgatctcaagccagccatggattaccatgcaaaagtccaggcagaatataattctataaagggaactccttcagaggctgaaatctttaccaccttgagctgtgaacctgatatacctaatccaccaaggatagccaatcggaccaaaaattcactcactttgcaatggaaggcacctagtgacaatggttctaaaatccaaaactttgtattagaatgggatgaaggaaaaggaaatggagaattttgtcagtgttacatgggctcacagaaacaatttaaaattactaaactttcaccagcaatgggctgtaaattcagactatcggccagaaatgactatggtacaagtggttttagtgaagaagtcttatattacacctcaggctgtgctccttctatgccagcaagtcctgtattaaccaaggctggaattacttggttatccttacaatggagtaagccctcaggaacaccatcagatgaaggaatttcttacattttagagatggaggaagaaacttcaggatatggttttaagcctaaatatgatggagaagatcttgcttacacagtgaaaaatctcagacgtagtactaagtataaatttaaggttattgcttacaactcagaaggtaaaagtaatccaagtgaagtagtagaatttactacttgccctgataaaccaggcatacctgtaaagccttcagtgaaaggaaagatacattcacacagttttaaaataacctgggatccaccaaaagacaatggcggagcaaccatcaataaatatgtagtggagatggcagaaggttctaacggaaacaaatgggaaatgatatacagtggtgctaccagggaacatctttgtgatcgactgaatccaggctgtttctatcgtttacgagtttactgcatcagtgatggaggacagagtgcggtctctgaatctttacttgtgcagactccagctgtgcctcctggcccatgcctccctcccagattacagggtagacccaaagcaaaagaaatacagttacgatggggaccccctctggttgatggtggatcacccatttcctgttacagtgtggaaatgtctcctatagaaaaagatgaacctagagaagtttaccaaggttctgaagtagaatgtacagtgagcagccttcttcctggaaagacatacagcttcagactacgtgcagctaacaaaatggggtttggaccattttcagaaaaatgtgatattactacagcccctgggccaccagatcagtgcaagccccctcaagtgacatgtagatctgcaacttgtgcacaagtgaattgggaggttcctttgagtaatggaacagatgtcactgaatatcgactggagtggggaggagttgaaggaagtatgcagatatgttactgtgggcctggtctcagttatgaaataaaaggactttcaccagcaactacctattattgcagggtccaggctctgagtgttgtgggtgcaggccctttcagtgaagtagtagcctgtgtgactccaccatcagttcctggcattgtgacctgtcttcaagaaataagcgatgatgagatagaaaatccccattattcaccttctacatgccttgcaataagctgggaaaagccttgtgatcatggttcggaaatccttgcctacagcatagactttggagataaacaatccctaacagtgggaaaggttacaagctatattatcaacaatttgcaaccagatacaacatacagaatacgaattcaagccttgaatagccttggagctggtcctttcagccatatgataaaattaaaaactaagcctctccctcctgatccacctcgtctggaatgtgttgcctttagccaccagaaccttaagctgaaatggggagaaggaactccaaagacattgtcaaccgattctattcagtaccaccttcagatggaggataagaatggacggtttgtatccctatacagaggaccatgtcatacatacaaagtacaaagacttaatgagtcaacatcctataaattctgtattcaagcttgtaatgaagctggggaaggtcccctctcccaagaatatattttcactactccaaaatctgtcccagctgccttgaaagcccccaaaatagagaaagtaaatgatcacatttgtgaaattacatgggagtgtttacagccaatgaaaggtgatccagttatttacagtcttcaagttatgttgggaaaagattcagaattcaaacagatttacaagggtcccgactcttccttccggtattccagccttcagctgaactgtgaatatcgcttccgtgtatgtgccattcgccagtgccaagactctctgggacaccaggacctcgtaggtccctacagcaccacagtgctcttcatctctcagaggactgaaccaccagccagcaccaacagagacactgtggaaagcacaaggacccgacgggcactgagtgacgagcagtgtgctgccgtcatccttgtgctgtttgctttcttttccattttgattgcctttatcattcagtactttgtaatcaagtgaaaatataactttattttttaactctattacattttattttgtcatgtactaaaattatttctgtattgcttttataaaaaacagtggcatttagcactggcattgagactatagcacatcatttttgccattttcagtgcttatattgttaggtagaggctggcactttattagaatgcaagccacaaaaatatcaattttgttttttttgttagggtgggtcttctttttttctttccctctctctttttttaacaaatgccttcttatagaaaaactttctaagaggcaacaatttagaatggatattttgacgaatcggcatgagtgtaacagtgataacctgatctgtttgttttaaagattattaccaagtgaaaaattcagaatgaatagaatttacactaacatgctatataaaatgttaaagtctgatgctgtgaaagcaatctagtgctatatttctacctcctcatttgtcttaattatttggtaagtgggattatgatgagtaactggaggggcttagaaacaaaaactggatgaaagagtatgcatgaagaaaagcttctttgataaatgtggagttcttcattataaatatatattcatgaattcacagataagtacttaaagaacagacagtttacttggcctaaaaatattttgatgtttactcaaaaagtacctcttcaggtcttgagaacatggaaaagaattgagtgcttttaaatactttttagaaagtaatcataaaagtaaattgaatttcaaacctatttggcttctgttttgtgaacctttgaactatatgtatgtgtataagggtatacacatacatatatggcatataacaagtgtacacatatacacataacaagtgtagaagtatatattacatacatacactcactctgtctggtataggctaattttgaagaactcccataagtttctgctgcttctcccataactgctgccaccaccatcagaattcataatcaaacctaacctttttgtttggggcaccaaatctgaagacaaaattaatttgcaccagtaaacttcaagctgctttctttcttgaaaactaaacgtttaacgtataatgtctgtttggatactgttccaaattgttgattgcatgtggttaatgttgcattagagcactttgcaattgcataattcattaatgttttgtgagcttgcatttgtgagttattggatgatcagactgaattttgtcaagtatcacattgtacatcttgcctagatgtcgatgactgcaagtaataatacagtttataatgaaactatctacaattcttgttttagcacatctgttatccgtaaaacacctgtaactagcttttttaatttattatttgaattttaggatagcgaatcactaatttttagttgctgaggttggcattttagtgattattaagcacttctgtcagtctttgaaaaaagaacgtattttttgtgctttgaagatctctgaagaatttcttttataatagaatgggcatgtattgtaacagttttatgtcaaatgatctgtgctgtagaaaaacattaacccttgttcaaaaaagaaatggataaacttggcctttctaagtggtaagaatgacctgtcactataatatactgtatgtttacattttatttaaatttaatctcttatgtatagggtgataaccttccccagaaacaacagtgattgcgattgttttctagaaacttctttaaagtgccacatttggcagtacaaatgagtctgagtgtaatagcccagagatttatatatagttgaatgtctaaaatggtaaaatgtgccactgtgtcaagttacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaactttttaaagattatagatacactaccaaacatatcaccttaaaattgtataaggctgaatgaacttcatacaaatgaaaaaaatctcataaaaatacataaactatgtagcaaaagtatctgtaaaatccatggaaaataaaagttgtatcattctttttga

SEQ ID NO: 2397 - DNA, 4841 bp, Homo sapiens
ctcccggctccgtagtaagcatggcggcggcggcgttcgtggtccctcgggtgaaacagaaagcgggagctacgcggagagggagcgaagagcggggctgaggcggcggcgtcactgccaggaaacaaccccaacagtcagcgcgccggcggccgcggcggccctgagagctgactctgcagctgaggtagagagacaacgatcaggaaccctaagaagaggcgccagaggagccgccttctgcctcagaacggcgtgactcggagaattggagcgttattcagtatattaatgtcttattgataatggcagaacatccaccactactggatacaactcagatcttaagtagtgatatttctcttttgtctgcccctattgtaagtgcagatggaacacaacaggttattctggtacaagttaacccaggagaagcatttacaataagaagagaagatggacagtttcagtgcattacaggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctatggagatgtagatgctcactctacacatggaaggtccaactttagagatgaacgatctagtaaaacatatgaacgtttgcagaaaaaattgaaggatcgccaaggaacacagaaagataaaatgagcagtccaccatcatcaccccagaaatgcccttctcccattaatgaacataatggacttataaaaggacaaattgctggtggtataaacacaggatcagcaaaaatcaagtctgggaaggggaaaggtggtacacaagttgatacagaaattgaagaaaaagatgaagaaactaaagcatttgaagcacttctttccaacattgtcaaaccagtggcctccgacatccaggcaaggacagtagtacttacctggtcaccaccttccagcctcattaatggtgaaacagatgaaagtagtgtaccagagctctatggttatgaagttctgatctcaagtactggaaaagatgggaaatacaaaagtgtatatgtaggagaagaaacaaatatcactttaaatgatctcaagccagccatggattaccatgcaaaagtccaggcagaatataattctataaagggaactccttcagaggctgaaatctttaccaccttgagctgtgaacctgatatacctaatccaccaaggatagccaatcggaccaaaaattcactcactttgcaatggaaggcacctagtgacaatggttctaaaatccaaaactttgtattagaatgggatgaaggaaaaggaaatggagaattttgtcagtgttacatgggctcacagaaacaatttaaaattactaaactttcaccagcaatgggctgtaaattcagactatcggccagaaatgactatggtacaagtggttttagtgaagaagtcttatattacacctcaggctgtgctccttctatgccagcaagtcctgtattaaccaaggctggaattacttggttatccttacaatggagtaagccctcaggaacaccatcagatgaaggaatttcttacattttagagatggaggaagaaacttcaggatatggttttaagcctaaatatgatggagaagatcttgcttacacagtgaaaaatctcagacgtagtactaagtataaatttaaggttattgcttacaactcagaaggtaaaagtaatccaagtgaagtagtagaatttactacttgccctgataaaccaggcatacctgtaaagccttcagtgaaaggaaagatacattcacacagttttaaaataacctgggatccaccaaaagacaatggcggagcaaccatcaataaatatgtagtggagatggcagaaggttctaacggaaacaaatgggaaatgatatacagtggtgctaccagggaacatctttgtgatcgactgaatccaggctgtttctatcgtttacgagtttactgcatcagtgatggaggacagagtgcggtctctgaatctttacttgtgcagactccagctgtgcctcctggcccatgcctccctcccagattacagggtagacccaaagcaaaagaaatacagttacgatggggaccccctctggttgatggtggatcacccatttcctgttacagtgtggaaatgtctcctatagaaaaagatgaacctagagaagtttaccaaggttctgaagtagaatgtacagtgagcagccttcttcctggaaagacatacagcttcagactacgtgcagctaacaaaatggggtttggaccattttcagaaaaatgtgatattactacagcccctgggccaccagatcagtgcaagccccctcaagtgacatgtagatctgcaacttgtgcacaagtgaattgggaggttcctttgagtaatggaacagatgtcactgaatatcgactggagtggggaggagttgaaggaagtatgcagatatgttactgtgggcctggtctcagttatgaaataaaaggactttcaccagcaactacctattattgcagggtccaggctctgagtgttgtgggtgcaggccctttcagtgaagtagtagcctgtgtgactccaccatcagttcctggcattgtgacctgtcttcaagaaataagcgatgatgagatagaaaatccccattattcaccttctacatgccttgcaataagctgggaaaagccttgtgatcatggttcggaaatccttgcctacagcatagactttggagataaacaatccctaacagtgggaaaggttacaagctatattatcaacaatttgcaaccagatacaacatacagaatacgaattcaagccttgaatagccttggagctggtcctttcagccatatgataaaattaaaaactaagcctctccctcctgatccacctcgtctggaatgtgttgcctttagccaccagaaccttaagctgaaatggggagaaggaactccaaagacattgtcaaccgattctattcagtaccaccttcagatggaggataagaatggacggtttgtatccctatacagaggaccatgtcatacatacaaagtacaaagacttaatgagtcaacatcctataaattctgtattcaagcttgtaatgaagctggggaaggtcccctctcccaagaatatattttcactactccaaaatctgtcccagctgccttgaaagcccccaaaatagagaaagtaaatgatcacatttgtgaaattacatgggagtgtttacagccaatgaaaggtgatccagttatttacagtcttcaagttatgttgggaaaagattcagaattcaaacagatttacaagggtcccgactcttccttccggtattccagccttcagctgaactgtgaatatcgcttccgtgtatgtgccattcgccagtgccaagactctctgggacaccaggacctcgtaggtccctacagcaccacagtgctcttcatctctcagaggactgaaccaccagccagcaccaacagagacactgtggaaagcacaaggacccgacgggcactgagtgacgagcagtgtgctgccgtcatccttgtgctgtttgctttcttttccattttgattgcctttatcattcagtactttgtaatcaagtgaaaatataactttattttttaactctattacattttattttgtcatgtactaaaattatttctgtattgcttttataaaaaacagtggcatttagcactggcattgagactatagcacatcatttttgccattttcagtgcttatattgttaggtagaggctggcactttattagaatgcaagccacaaaaatatcaattttgttttttttgttagggtgggtcttctttttttctttccctctctctttttttaacaaatgccttcttatagaaaaactttctaagaggcaacaatttagaatggatattttgacgaatcggcatgagtgtaacagtgataacctgatctgtttgttttaaagattattaccaagtgaaaaattcagaatgaatagaatttacactaacatgctatataaaatgttaaagtctgatgctgtgaaagcaatctagtgctatatttctacctcctcatttgtcttaattatttggtaagtgggattatgatgagtaactggaggggcttagaaacaaaaactggatgaaagagtatgcatgaagaaaagcttctttgataaatgtggagttcttcattataaatatatattcatgaattcacagataagtacttaaagaacagacagtttacttggcctaaaaatattttgatgtttactcaaaaagtacctcttcaggtcttgagaacatggaaaagaattgagtgcttttaaatactttttagaaagtaatcataaaagtaaattgaatttcaaacctatttggcttctgttttgtgaacctttgaactatatgtatgtgtataagggtatacacatacatatatggcatataacaagtgtacacatatacacataacaagtgtagaagtatatattacatacatacactcactctgtctggtataggctaattttgaa

SEQ ID NO: 2398 - DNA, 4649 bp, Homo sapiens
ttgacacggctttggaaacgacgtcatgtgttagaattggagcgttattcagtatattaatgtcttattgataatggcagaacatccaccactactggatacaactcagatcttaagtagtgatatttctcttttgtctgcccctattgtaagtgcagatggaacacaacaggttattctggtacaagttaacccaggagaagcatttacaataagaagagaagatggacagtttcagtgcattacaggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctatggagatgtagatgctcactctacacatggaaggtccaactttagagatgaacgatctagtaaaacatatgaacgtttgcagaaaaaattgaaggatcgccaaggaacacagaaagataaaatgagcagtccaccatcatcaccccagaaatgcccttctcccattaatgaacataatggacttataaaaggacaaattgctggtggtataaacacaggatcagcaaaaatcaagtctgggaaggggaaaggtggtacacaagttgatacagaaattgaagaaaaagatgaagaaactaaagcatttgaagcacttctttccaacattgtcaaaccagtggcctccgacatccaggcaaggacagtagtacttacctggtcaccaccttccagcctcattaatggtgaaacagatgaaagtagtgtaccagagctctatggttatgaagttctgatctcaagtactggaaaagatgggaaatacaaaagtgtatatgtaggagaagaaacaaatatcactttaaatgatctcaagccagccatggattaccatgcaaaagtccaggcagaatataattctataaagggaactccttcagaggctgaaatctttaccaccttgagctgtgaacctgatatacctaatccaccaaggatagccaatcggaccaaaaattcactcactttgcaatggaaggcacctagtgacaatggttctaaaatccaaaactttgtattagaatgggatgaaggaaaaggaaatggagaattttgtcagtgttacatgggctcacagaaacaatttaaaattactaaactttcaccagcaatgggctgtaaattcagactatcggccagaaatgactatggtacaagtggttttagtgaagaagtcttatattacacctcaggctgtgctccttctatgccagcaagtcctgtattaaccaaggctggaattacttggttatccttacaatggagtaagccctcaggaacaccatcagatgaaggaatttcttacattttagagatggaggaagaaacttcaggatatggttttaagcctaaatatgatggagaagatcttgcttacacagtgaaaaatctcagacgtagtactaagtataaatttaaggttattgcttacaactcagaaggtaaaagtaatccaagtgaagtagtagaatttactacttgccctgataaaccaggcatacctgtaaagccttcagtgaaaggaaagatacattcacacagttttaaaataacctgggatccaccaaaagacaatggcggagcaaccatcaataaatatgtagtggagatggcagaaggttctaacggaaacaaatgggaaatgatatacagtggtgctaccagggaacatctttgtgatcgactgaatccaggctgtttctatcgtttacgagtttactgcatcagtgatggaggacagagtgcggtctctgaatctttacttgtgcagactccagctgtgcctcctggcccatgcctccctcccagattacagggtagacccaaagcaaaagaaatacagttacgatggggaccccctctggttgatggtggatcacccatttcctgttacagtgtggaaatgtctcctatagaaaaagatgaacctagagaagtttaccaaggttctgaagtagaatgtacagtgagcagccttcttcctggaaagacatacagcttcagactacgtgcagctaacaaaatggggtttggaccattttcagaaaaatgtgatattactacagcccctgggccaccagatcagtgcaagccccctcaagtgacatgtagatctgcaacttgtgcacaagtgaattgggaggttcctttgagtaatggaacagatgtcactgaatatcgactggagtggggaggagttgaaggaagtatgcagatatgttactgtgggcctggtctcagttatgaaataaaaggactttcaccagcaactacctattattgcagggtccaggctctgagtgttgtgggtgcaggccctttcagtgaagtagtagcctgtgtgactccaccatcagttcctggcattgtgacctgtcttcaagaaataagcgatgatgagatagaaaatccccattattcaccttctacatgccttgcaataagctgggaaaagccttgtgatcatggttcggaaatccttgcctacagcatagactttggagataaacaatccctaacagtgggaaaggttacaagctatattatcaacaatttgcaaccagatacaacatacagaatacgaattcaagccttgaatagccttggagctggtcctttcagccatatgataaaattaaaaactaagcctctccctcctgatccacctcgtctggaatgtgttgcctttagccaccagaaccttaagctgaaatggggagaaggaactccaaagacattgtcaaccgattctattcagtaccaccttcagatggaggataagaatggacggtttgtatccctatacagaggaccatgtcatacatacaaagtacaaagacttaatgagtcaacatcctataaattctgtattcaagcttgtaatgaagctggggaaggtcccctctcccaagaatatattttcactactccaaaatctgtcccagctgccttgaaagcccccaaaatagagaaagtaaatgatcacatttgtgaaattacatgggagtgtttacagccaatgaaaggtgatccagttatttacagtcttcaagttatgttgggaaaagattcagaattcaaacagatttacaagggtcccgactcttccttccggtattccagccttcagctgaactgtgaatatcgcttccgtgtatgtgccattcgccagtgccaagactctctgggacaccaggacctcgtaggtccctacagcaccacagtgctcttcatctctcagaggactgaaccaccagccagcaccaacagagacactgtggaaagcacaaggacccgacgggcactgagtgacgagcagtgtgctgccgtcatccttgtgctgtttgctttcttttccattttgattgcctttatcattcagtactttgtaatcaagtgaaaatataactttattttttaactctattacattttattttgtcatgtactaaaattatttctgtattgcttttataaaaaacagtggcatttagcactggcattgagactatagcacatcatttttgccattttcagtgcttatattgttaggtagaggctggcactttattagaatgcaagccacaaaaatatcaattttgttttttttgttagggtgggtcttctttttttctttccctctctctttttttaacaaatgccttcttatagaaaaactttctaagaggcaacaatttagaatggatattttgacgaatcggcatgagtgtaacagtgataacctgatctgtttgttttaaagattattaccaagtgaaaaattcagaatgaatagaatttacactaacatgctatataaaatgttaaagtctgatgctgtgaaagcaatctagtgctatatttctacctcctcatttgtcttaattatttggtaagtgggattatgatgagtaactggaggggcttagaaacaaaaactggatgaaagagtatgcatgaagaaaagcttctttgataaatgtggagttcttcattataaatatatattcatgaattcacagataagtacttaaagaacagacagtttacttggcctaaaaatattttgatgtttactcaaaaagtacctcttcaggtcttgagaacatggaaaagaattgagtgcttttaaatactttttagaaagtaatcataaaagtaaattgaatttcaaacctatttggcttctgttttgtgaacctttgaactatatgtatgtgtataagggtatacacatacatatatggcatataacaagtgtacacatatacacataacaagtgtagaagtatatattacatacatacactcactctgtctggtataggctaattttgaagaactcccataagtttctgctgcttctcccataactgctg

SEQ ID NO: 2399 - DNA, 6082 bp, Homo sapiens
agccgccgaacttgaacgcttttctgaagagagttttccccgctcatcttggggttaaaacctcgaaaacccgccctctgtttgatcctgcgtggctgcttccagtacctggcagttcctctccccgggcgagttaaccacctgttcagtcgggaggtggactcgaggctgcagtcctcgcccggttttaacaacctggatcttcgaacttttgacacggctttggaaacgacgtcatgtgttagaattggagcgttattcagtatattaatgtcttattgataatggcagaacatccaccactactggatacaactcagatcttaagtagtgatatttctcttttgtctgcccctattgtaagtgcagatggaacacaacaggttattctggtacaagttaacccaggagaagcatttacaataagaagagaagatggacagtttcagtgcattacaggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctatggagatgtagatgctcactctacacatggaaggtccaactttagagatgaacgatctagtaaaacatatgaacgtttgcagaaaaaattgaaggatcgccaaggaacacagaaagataaaatgagcagtccaccatcatcaccccagaaatgcccttctcccattaatgaacataatggacttataaaaggacaaattgctggtggtataaacacaggatcagcaaaaatcaagtctgggaaggggaaaggtggtacacaagttgatacagaaattgaagaaaaagatgaagaaactaaagcatttgaagcacttctttccaacattgtcaaaccagtggcctccgacatccaggcaaggacagtagtacttacctggtcaccaccttccagcctcattaatggtgaaacagatgaaagtagtgtaccagagctctatggttatgaagttctgatctcaagtactggaaaagatgggaaatacaaaagtgtatatgtaggagaagaaacaaatatcactttaaatgatctcaagccagccatggattaccatgcaaaagtccaggcagaatataattctataaagggaactccttcagaggctgaaatctttaccaccttgagctgtgaacctgatatacctaatccaccaaggatagccaatcggaccaaaaattcactcactttgcaatggaaggcacctagtgacaatggttctaaaatccaaaactttgtattagaatgggatgaaggaaaaggaaatggagaattttgtcagtgttacatgggctcacagaaacaatttaaaattactaaactttcaccagcaatgggctgtaaattcagactatcggccagaaatgactatggtacaagtggttttagtgaagaagtcttatattacacctcaggctgtgctccttctatgccagcaagtcctgtattaaccaaggctggaattacttggttatccttacaatggagtaagccctcaggaacaccatcagatgaaggaatttcttacattttagagatggaggaagaaacttcaggatatggttttaagcctaaatatgatggagaagatcttgcttacacagtgaaaaatctcagacgtagtactaagtataaatttaaggttattgcttacaactcagaaggtaaaagtaatccaagtgaagtagtagaatttactacttgccctgataaaccaggcatacctgtaaagccttcagtgaaaggaaagatacattcacacagttttaaaataacctgggatccaccaaaagacaatggcggagcaaccatcaataaatatgtagtggagatggcagaaggttctaacggaaacaaatgggaaatgatatacagtggtgctaccagggaacatctttgtgatcgactgaatccaggctgtttctatcgtttacgagtttactgcatcagtgatggaggacagagtgcggtctctgaatctttacttgtgcagactccagctgtgcctcctggcccatgcctccctcccagattacagggtagacccaaagcaaaagaaatacagaccccctctggttgatggtggatcacccatttcctgttacagtgtggaaatgtctcctatagaaaaagatgaacctagagaagtttaccaaggttctgaagtagaatgtacagtgagcagccttcttcctggaaagacatacagcttcagactacgtgcagctaacaaaatggggtttggaccattttcagaaaaatgtgatattactacagcccctgggccaccagatcagtgcaagccccctcaagtgacatgtagatctgcaacttgtgcacaagtgaattgggaggttcctttgagtaatggaacagatgtcactgaatatcgactggagtggggaggagttgaaggaagtatgcagatatgttactgtgggcctggtctcagttatgaaataaaaggactttcaccagcaactacctattattgcagggtccaggctctgagtgttgtgggtgcaggccctttcagtgaagtagtagcctgtgtgactccaccatcagttcctggcattgtgacctgtcttcaagaaataagcgatgatgagatagaaaatccccattattcaccttctacatgccttgcaataagctgggaaaagccttgtgatcatggttcggaaatccttgcctacagcatagactttggagataaacaatccctaacagtgggaaaggttacaagctatattatcaacaatttgcaaccagatacaacatacagaatacgaattcaagccttgaatagccttggagctggtcctttcagccatatgataaaattaaaaactaagcctctccctcctgatccacctcgtctggaatgtgttgcctttagccaccagaaccttaagctgaaatggggagaaggaactccaaagacattgtcaaccgattctattcagtaccaccttcagatggaggataagaatggacggtttgtatccctatacagaggaccatgtcatacatacaaagtacaaagacttaatgagtcaacatcctataaattctgtattcaagcttgtaatgaagctggggaaggtcccctctcccaagaatatattttcactactccaaaatctgtcccagctgccttgaaagcccccaaaatagagaaagtaaatgatcacatttgtgaaattacatgggagtgtttacagccaatgaaaggtgatccagttatttacagtcttcaagttatgttgggaaaagattcagaattcaaacagatttacaagggtcccgactcttccttccggtattccagccttcagctgaactgtgaatatcgcttccgtgtatgtgccattcgccagtgccaagactctctgggacaccaggacctcgtaggtccctacagcaccacagtgctcttcatctctcagaggactgaaccaccagccagcaccaacagagacactgtggaaagcacaaggacccgacgggcactgagtgacgagcagtgtgctgccgtcatccttgtgctgtttgctttcttttccattttgattgcctttatcattcagtactttgtaatcaagtgaaaatataactttattttttaactctattacattttattttgtcatgtactaaaattatttctgtattgcttttataaaaaacagtggcatttagcactggcattgagactatagcacatcatttttgccattttcagtgcttatattgttaggtagaggctggcactttattagaatgcaagccacaaaaatatcaattttgttttttttgttagggtgggtcttctttttttctttccctctctctttttttaacaaatgccttcttatagaaaaactttctaagaggcaacaatttagaatggatattttgacgaatcggcatgagtgtaacagtgataacctgatctgtttgttttaaagattattaccaagtgaaaaattcagaatgaatagaatttacactaacatgctatataaaatgttaaagtctgatgctgtgaaagcaatctagtgctatatttctacctcctcatttgtcttaattatttggtaagtgggattatgatgagtaactggaggggcttagaaacaaaaactggatgaaagagtatgcatgaagaaaagcttctttgataaatgtggagttcttcattataaatatatattcatgaattcacagataagtacttaaagaacagacagtttacttggcctaaaaatattttgatgtttactcaaaaagtacctcttcaggtcttgagaacatggaaaagaattgagtgcttttaaatactttttagaaagtaatcataaaagtaaattgaatttcaaacctatttggcttctgttttgtgaacctttgaactatatgtatgtgtataagggtatacacatacatatatggcatataacaagtgtacacatatacacataacaagtgtagaagtatatattacatacatacactcactctgtctggtataggctaattttgaagaactcccataagtttctgctgcttctcccataactgctgccaccaccatcagaattcataatcaaacctaacctttttgtttggggcaccaaatctgaagacaaaattaatttgcaccagtaaacttcaagctgctttctttcttgaaaactaaacgtttaacgtataatgtctgtttggatactgttccaaattgttgattgcatgtggttaatgttgcattagagcactttgcaattgcataattcattaatgttttgtgagcttgcatttgtgagttattggatgatcagactgaattttgtcaagtatcacattgtacatcttgcctagatgtcgatgactgcaagtaataatacagtttataatgaaactatctacaattcttgttttagcacatctgttatccgtaaaacacctgtaactagcttttttaatttattatttgaattttaggatagcgaatcactaatttttagttgctgaggttggcattttagtgattattaagcacttctgtcagtctttgaaaaaagaacgtattttttgtgctttgaagatctctgaagaatttcttttataatagaatgggcatgtattgtaacagttttatgtcaaatgatctgtgctgtagaaaaacattaacccttgttcaaaaaagaaatggataaacttggcctttctaagtggtaagaatgacctgtcactataatatactgtatgtttacattttatttaaatttaatctcttatgtatagggtgataaccttccccagaaacaacagtgattgcgattgttttctagaaacttctttaaagtgccacatttggcagtacaaatgagtctgagtgtaatagcccagagatttatatatagttgaatgtctaaaatggtaaaatgtgccactgtgtcaagttacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaactttttaaagattatagatacactaccaaacatatcaccttaaaattgtataaggctgaatgaacttcatacaaatgaaaaaaatctcataaaaatacataaactatgtagcaaaagtatctgtaaaatccatggaaaataaaagttgtatcattctttttgagatacgtttattgt

SEQ ID NO: 2400 - DNA, 2125 bp, Homo sapiens
aatgatgctgatctgaagaaatgaataatgtgagcattaggggcggcagtgggattactcagtgttgagagaaacaacacggaaagcccagagcagaggagggagaaggccccattctctcagctttaatctactgcacctcggagggcagagctctaaccagacacgctgcaagcatcagaatcgggatgaacatcgaggtggggaacatttcttatacaggagccatcatctcctggtcgtcctcggagccctgcctggaggactattaccatattatgtacaggcccaactggaacagcatcttctctggctatcttcgctacagcttccaccacgaggagaaggtgcctcgaacgatcagctccgtggtgctggaacatcttgccccttccactctctacttcctgtgcatcagctgtaagaaggctgccttcccttacaggcactactgcaccatgttccacaccctggataagagtccgctggctcctggaagctccctggtagacccccagatctccctttgggtgctgatggccattctgctggcctgcttcacagccgtcttggccttcatctgcctccagttctggtgtgtccgttgccatgagccgcgatggtcttacagggctggccacatggaggaggccaatgggttggtgagatggccagaggaggccccggatcttggtcagagggaggaagacctgcaggggctccccctggtggaaatgccacgcaagaactccagagatggagctgaactggatcccgaagccaaccaggatgcccctgatgcgggtgccttacagagggggggtggtgacccacccgctatactgcctcattgtggggaatgagagtggggaggagagcgcccgcatcatgtagcctaaagctttccacacagtaggtcgtttgtacaaatgtgtctatagactacccatttctctcccatcaaacgtcactgctattgtaggtcacctgggttggatgaatgccccatgacaaagcttctcaagctggaaaatgtatcccccagggtatgccaaggcacaaacgaggcatctcagcagcagcgtccactcggaggacacagttaagaattgaaagcattgttttaacattaaaacaaacatggatatgttataaagtagaaagcaaaaatttgcatgacaaataaaacacagcacttgaaggaaacacttgagttacaagtaggctctcagaggtacacttttgggcaaaggtagatgtccagtttcctctgcccttgaggggattatttggaaataatttgggattatttggaaataatttgtgagaacccttgctctggagtgttttccaacttttaggcaatcacataccaccgctctctattttttaaaaccatggattatcttcactattattaataatactttcctttaaattgactcattttttaagcgtaaacttattttcaaagacagccttatattactccataagtgaaaaaccagcaccctcctgctgcaaacagaagggaagagacataagaataaacatcatgaaaacaagataatattaaataatctgacttagcttctattgcctgccagtgattctgagcttaatgcctgcttgcttgtctttgataaaaagggagatccagtgttggagaggtaataaagacatattagcaccaatatttgtctttctccttgatatagcataaggtttgaaagagaatcgaaaagggaagtgctgtttttactttgcgagtcagtgttagttaaatgccatgtctgtgaaccacctcaaatgctgtcagtcagcttcccttgatttgagaaaattgtcttgaccagactaggcaggctgttctggagaagacgcctgtactctccaagcatcatccaagaccttcccagtaccctcttatatctatagagcacaaaatcccagaatcacaggacgacactgcagtgaatcaactaagaaacagcaggagctgagaagccaagacgagaagccccacatccctattcccttgcctacctcatgcattccctgctcggcacccagacttttgcccccattcctgctacttgtgaacaaataaagattcatatactca

SEQ ID NO: 2401 - DNA, 732 bp, Homo sapiens
aaccagacacgctgcaagcatcaggtaagacatatagatggctcttcttggaaatggaaatggcttcttttcacactctgcttggagaagggccgggcaaatgaatagttaaaaataggggagaatttagaaacggaaacagaggaagaaaaatcaataagggagacggacctggtcctaaaagaatcgggatgaacatcgaggtggggaacatttcttatacaggagccatcatctcctggtcgtcctcggagccctgcctggaggactattaccatattatgtacaggcccaactggaacagcatcttctctggctatcttcgctacagcttccaccacgaggagaaggtgcctcgaacgatcagctccgtggtgctggaacatcttgccccttccactctctacttcctgtgcatcagctgtaagaaggctgccttcccttacaggcactactgcaccatgttccacaccctggataagagtccgctggctcctggaagctccctggtagacccccagatctccctttgggtgctgatggccattctgctggcctgcttcacagccgtcttggccttcatctgcctccagttctggtgtgtccgttgccatgagccgcgatggtcttacagggctggccacatggaggaggccaatgggttggtgagatggccagaggaggccccggatcttggtcagagggaggaagacctgcaggggctccccctgg

SEQ ID NO: 2402 - DNA, 10398 bp, Homo sapiens
atggagctgtacctcggcgcctgctccaagcctgccaaagtcgccgtcaccaagacggtcgccagcgtcctggccgcggacacccagcagtgcagagacggcgtgcacaaaacccactttgcaggggttggaccggctcagctactggacctacctctcggggtcaagctgcctgtgatcccaggaagcaatgctgtattctatactacgaatttcggtgaaaagctttttcgaccttcttatggttttaacctgactgatccctattgtcgacttttggaaaaccaatataaaagcctccatgatccacatttaaaagcatactataagcgcaaagatattttgaagagattaaagaaaggtggctacatcaccagcaataataaagttgtatgtaccttgagagaattgaataagtacaggcaatatcttaccagtttaaaattagactttgagagaaactatataaaagaacaaagaatacttgcaaaacaactacataacataccggaaaacaatcaaatccctcaacattgtgatgttgcacaagtccaaaactggttgttaaaggagggcactgaatctattaaggaccaggagcggctgatgaggcatagatatttggatatgataagtagaaaactagaacaacttgaacgcacagcagaagaacaacgcctattcctaatggatagagaagaaagacgacagcgggaacacacaagaagaaaacttactcttcgtagaaaaatagaagaggaatggaagacaaaagagatgttacttctgacaaggatggcagaagatgttaaaagagaagagaggatagaagaacaacagcatagaaacagagaagagagtgacaggaagaaacaagatcttctagagaaaaaaatggcttatcatttacaaaaaatgcaagatactggctttaacggagaagatataggaaaaaatacatttaaatacagaggtcaagatggaacacatgcttctccaaagaataaaaagaagacttctgaagatataatgttagtttatcctgctggagaccagaatacatataaagaaacacatggacatacagcaaatgctgctcatcagcgtcaaaatagttcaaataattttacgaaaaaaaactcagcttctgttgtttatcaggcagatgtacaggataatggtataaatcaaaagagagatgggatggtatctaaaaactcaagtattttcgatgatagaggaggtataaatatttcaggccaaggttcaattatttcagcgcaggtatcacccacgagaaatttttccagagtttcacaggcatttttggatccttcaaaagaagagaaggagacaaatgctgattgggatggaagaccaaccaagagatcaagctatctctgcgaatcaggacctcaggctcatgctacagacccgggtatattttcttctcctgtttacacaaatatgcaacagaacttgctgcaaaattgcttgcaagaaaaagtaacttctgaagaactgaatattataattcagaatgtaatgacctgggttgtggctacagtgaccagtatattgtacccagccatcacaaagtatgaaaaaagattgcaaaataatacatacccagtatctgatgactccatcctctcttcagatagttcaagtttctgtagcacgtgcagtgaagactttacatatagaagctacacatctgcaacaactaaaacatttcaggcagaaccctgtgcatttgtagttgacacgtcagtaaggagaccaaccacacctataaaacctcctcctgcacatgtggaaaaaacagttgtggggaaaacatgtcacataaaaggacaatctataatctctaaacataaatataataaaaccaacttgctatattcataccctaagctcagaagttgtaaatcagatagtcaccttttagcatcatttgaaacaggcacaaaaaaatctaaggatgctaccactgaaacagatagcttagggagttcattgcattgtgataaaacagcaaaagccatggatgaaatgaagaatttaaaaaatgtttttgttaactttaaatgttacttgaaaggggaaactgaagtgattttagaaagcattttgcgagaaataatgtctgatttaacccaggccattccctctctctcttctgttactgctgaagtttttgttgaacaatgtgaacgtgaaaaagaaatcttgctttccaatgctcatattccctcagttgcttctgagattgtggaaaatatgcttgagaagttagagtctgcagttgagaaaaaatgtgttgagatgttttcacaagatttgtcagtcgacattaaaccaagtttagcagccagtgatgaacttctcacatcatctaatggaaaacctttgaaaaattcaatgcctcatactttggacccaatgtgtgatattgcagaggacatggtgcatgccattttagaaaagctaatgactcttgtttcttttaagcaaaatgaatttcttcatcttaaagacacaaataagctttcctgccagcaacataagacagacccaatatgtatgttccttcaaagagctggcaaaaataaatctagtcttgaatctgatgaagctagtttaattgtcaatgaagaagtacaaaatttaatatcaaatattttttcccagtcttctttggttgcttatatagaggaagcaatcaatgctatactaggttatatacaaactgaactaaataatgagagaattattgcatctgaagaaaccgtagtactccttcagctacttgaggacatcctttttcagctccatcaggaaccagtaaatgaaagttttcaaaaaagtaggcaacctagaataagtagtccttctgacaccaaagaaaagtacagactcactggcactagattatcaaatagtcctaggtctggaagaccatttccacctataaatgttccaggcatggttctttattctgatgatgaaaatgaggaaatagacaatattgtaaaaaatgtgcttgattcaactttcaaagatgaaaaagtaaaatcacaagaacagattcctaatcattggtttacaaagggaaacacttgttttgaatgcaaaagaaatatcaaaccacctacaaagcctggttctagaagcaaagctgcatttcatgattgggaattaaagactgagccaccatctactaatcatgaagatattttaaagaaaaaactttcttcgaataaagacatttcaactttcagccaagatcaaaagcatcaaatagaaaaggcttcagaaaacatagtcacaagtattttaaaggaaatgctcaaggacatatcttccgttccttttggtcacttagacagcaaaactggcagtgaagcttcagttcttgtttcagaaaagcctcaaggactgtcacatcaagaatggatagaccagatgttttctgtttcagaaatcagtacagtggctcaagaaataacagattctgtgttaaacatacttcataaggcatcaaactacatttccaataccactaaaagttccatttcatcatcagttcatcagatttccttacataattctgacactgaacacatagtcaaagaagcaccaaataaatacccattaaaaacatggtttgacagtgaaaagaaaatgaaatatttatctttatttgacgttgatcctgaaaagcctccctggttaaaatctggaaaaagtgaacctaaacctgtagatgacattaatgataagatcattcgtacaatttttaaaagactgaagtcatttatttgtccaaaattgcatatgggcttcaaatcttcattacgatctcaacttagtaagtacacagctaaaatagtaaacattgttttatgtgctatccagaatgaactggaacttcacaaggaaaacctaaatcttagggagattgaccataccaaatcccttacagataaaggattttttgctaatactgataaaaaattagaatctcttgtcacgagtattgatgatgacattttggcgagtccattattaacctgtatttatgatatgttgttatcaagtgaaaatgcacatcaaagaagcatttcactctcttctcgtaagccaaagtctgcaactgacagtgttgatgtacaaagcattttgccaaataggcaagataaaaaatcttttcacaaatatttggctactccttgtactcaccacagtgtcaatggtggaaaccatattaaagagaatgcaaaattgcaagtgttagaaagaattggggaaacactacatgaaatgttaagcaagctcctggggacccatcttcattctcagctatcttgtagtcaacaaagcagagagatgaccaataagaatcagaaaatggctgctgcattgcagtctaatattcagttaatttctaaagcaattttggattatatccttgcaaaattatgtggtgttgacatggataccagttttgcaagttgtggattaaaagctatctcagagtctcttgacattgacaacccatcatttgcttcaattattgagaaaatggccaaatccaccaaaataatctccagcatagtttccagaagggttcaggaggacaataaagaagagactaaaagcaaggcaaaacctgttgctcctgtgtcttccaaaacaccaagcacaaaagaaatgcatccaaataaactaaaagctgtagcttcagatattcttaatatggtttttgctaaactggaagggtttgccaacggacatttagaaattttgggtgctattaatgatggaaataagaaaagcaataagataggctgggaatatgaaagcaccaatatttccagagacacacatgaagcatcatttctgtctgctttatatatgcatgcaaagaaggtatcaagtgctattttgaaggttattcaaacagaattaaatgtgacctcatcagatttgaagacaagtgtagaaaacccaccacctgagactcaaatacttaagtatgtagtcaagttaattttagatgcagtatcttccgatatgtttaatgaaatggaatctgaagggggaggcattgaaacttatcgatacaggccaacatatggaagtcttcctggaggagctgaatcagattcatttctagaagatgatgcatatacagcgaaaaaaattattgatgagagatccccacaaagagaagaagtgaaaacacgttctcttaaacaatgggctctcgaaaaaaccttaaacaaaattgaagtaaaactcaaagaaccacatatatctccaattgctcccattataagaaatattttgaatgaaatttttcaaagtactttaatcaatcaattaaatgtcctttctctctcccactctaattttaatggcatgcctcacaatgttgatgagccaactccccaaacatctgttcaatttatggataaaatgatggatcctttactttcggaagcagatataaccatagtaacagataatattgttaggactgtatttcacaaactttattcagctgccatgacagaaagaaatgtaagggaaaataggtataaaactatcactttttcagcaaatgtttcttctcatgaacacacctataaaggaaagtcctctgtcacggctttggatgaaaatccatgtacttttcagtctagattcagcgttgctgacaaggagacaaaggtaaatctagctgaagatattgtacaggcaatattaacaaatttagaaacttttgctacttccaaagtaaaatctctcttttattctcaagtcaactttacagttccagtggctttacctattcagcaagatcacagtacattgagcaaagcattatcagccaaagattcatattctgatgagcaattttcctgttgctcagtagatcataccaagtcaggaaagaccaacttgtgccaactgtctttgtctaaattaaatacttatgcactacaagtggctagaagaaatttacaaggaatcaaacaggaattagataaagaaagggaaaatccttttttaactcatgacattgggatttctgaaagtattgcaagtcaaattgttaacgcattgttagacattatatcacgtaaaggcaaatgtgacaaaaacagttctgacaaagagatcgatttagatcagcaaaaaggtgttattgaaaagctgctcaatgagaccaaatatcgaaaagtacttcaacttcaaatacaagataccattgaaggtatcctatgtgatatttatgaaaaaaccctgtttcagaataatctctcatttgccacacccactctgaaatgtagcatagctgataaacattcagaagaaaattctgaaatgttcatggagggtgcaaataagattattcctaagctttcagttcctaaatcagatgtcattttgatatccaatgatatagtgaatattgttcttcataatctcagttctgctgccacgcttgtcataaatgcaaagaatcctacttctgcaagattgcccctgacattttgtgatacgtttccaaaaatagactgtcaacagcctcttaaggggtcaaaaactgaaagaaaaacagagcgtttttcatattcaagaaatcagaaatcagcttatgctgatgataatcagataactgtagtagagaaagaagacactcagaaatctgctactgactcatgtgaggaaaatgctaacttcattactaaaactatttttaaacgtttggaatcttttgccacagaaagaatagattcattaattacccttgctttccaaagtaaagaaaagtcatttgttatcccagaattggaaaattgtaaacaaaatgacagcatcttttatgattcaagccaagtggaatcagatgtaaatgtcctgaaaatatcagcaactgaaaccattctcagccaagagcttacagatttcacttttgttggtcgcagagaaaaacttggatccacaattcacctatcgcaagctaggcttaagacatatgctgacgtcattgccagtgccattttgaagcttattaaaaatgacttagacttagaaattcaaaagatatatccatatcaaaacaatattttgttccaagaaaacatcattgtgagtgaaattgttgacagtatgttaaagatgttagatgataaaagatctgtaaaggaaatttgttttaattcaaaagaaaattctaacttttcacaattagctttatcaaatgaaatattgctgggtcacaaagagaaggaaagaagtaccaaacaatctctatttacaaagtatccattagagcaaaaccaaatgatattggaaaacaaaaggcagataattgttttggaagaaatatttatgagaaatggagaatcaaaaaacaaagaaaaaggtgaactgctcattgcagtggaagaacttttgaataagttgtatcaaagagtaagggaagtcacaggccatttgcctccacttaatgaaactgccaactttatatctaattctaagattaaaacatcagacacaacacagaaaaacagttttcaatcacatattaacagtgtagcaaatgacatagttgaaagtgttttggggaaaatgtacttggtagttgtgacatcattatatgaaaataataaaagtaggacagaagttgaaatatctgaccacaatgattccttactaatgaaaccattaaggtttagagaaactaaacaagcaggaaaaataagtaattcccctagatatgcgatatcacaggcttattcttatgtcgacagtcaaaatatctctgtgatggaaaacactcttttgccatatttaccattgcaagtgaagaaagacttaattcaaatggttctcaataagatcacaaattttgtctcacttcctttaaaggtgagccctaaggacaaccctaagccatgctttaaagcacatttaaaaacaagatcaaaaattaccactttgcctaaatttacaaaaaaaacacacttaggactgagtgctgctaaggccaaaagcaaaaccaagttaggtcctggagagaagaccctaaaagacagcagatccaagactgccattgggttgtcacacatcatgtcagctggagatgccaaaaatttactggacacaaaattgcccacttcagaactaaaaatatatgccaaggatataataattaacatcctagaaacaattgtgaaggaatttggaaaggtaaagcaaaccaaagctttaccatctgatcaaatcatagcagcaggtaaaatagttaatacagttttgcaagaattatatgttaccaataactgcaatttggcttacccgatgaaatcctcacatctcagactttcacaggggaatataggcacaggatcccttcctaaacaacaagcatgtttttacttggagaatgtttcttcacagctagagcacatttttcctagagaaggtatatttaaaaaattgtttgacaagtggcaaacagaatcaaatgacaaggaaaatgaaaaatgtaagctattgatgatagctgaaaatgttttgactgaaatttcaataaaagcaaaagaattagaatattctctttcacttttaaatttgccccctcttgagaattgtgaaagcaggttttataatcattttaaaggagcttctactagagccgaggatactaaagcacaaattaatatgtttggaagggaaattgttgaaatgctacttgaaaaactacagctatgctttctgtcccaaattcccactccagatagtgaagaaactctatcaaacagtaaagaacacattactgctaaaagtaaatatggttttccaaacaagcatagcctcagcagtttaccaatctataacacaaagacaaaagaccaaatttctgtgggctccagcaaccaaattgttcaagagattgtagaaacggttttaaacatgttagagtcatttgtggacttgcagtttaaacatatctccaaatatgagttttctgaaattgtgaaaatgcctatagaaaacctttcttctatccaacagaaactgttaaacaaaaaaatgttgccaaaattacaaccactgaaaatgttttctgataaatccgagtcaaatactattaatttcaaggaaaacatacagaatatccttctacgggttcattcattccattcacaattacttacatatgctgttaatatcatcagtgacatgcttgctgtaattaagaacaagctagacaacgaaataagccaaatggaaccatcttcaattagcatattgaaagagaacattgtagcaagtgagatcattggcacactaatggaccagtgtacttatttcaatgagtctttgatacaaaacctttcaagagaaagtttgttccaaggagctgaaaatgcctacactgttaatcaggttgaattagcaactaatatgaaaatgttcacatcaaagttaaaggaaggtagtttggggattaatccttcacaagtgagtaaaactgggtttgtgttttgttcagatgaagatatgaaagaaaagtacagggtttcatcagatttacccacctctgtcagatcctctgtagaagacacagttaaaaactcagagccaacgaaaaggcctgattcagaaactatgccatcgtgttctactagaaacaaagtacaagaccacagaccaagggaatctaactttggtagttttgatcagaccatgaaaggaaatagctacctccctgaaggcagtttcttacaaaagctgcttaggaaagcaagtgactccacagaagcagcattaaagcaagtcttgtcattcatagaaatgggaaaaggtgaaaatctaagagtgtttcattatgagaacctaaaaccagttgttgaaccaaaccaaattcagacaaccatttcccctctcaaaatatgtttagctgcagaaaatattgtcaatactgtgctatccagctgtggctttccaagtcaaccacacactaatgagaacagggaaataatgaaaccatttttcatatcaaaacaaagctctttatctgaagtatctggagggcaaaaggataacgaaaaaagtttgcttagaatgcaggataaaaaaatcaactatatacctgaggaagaaaatgaaaaccttgaagccagccgggaagattcttcttttttgcaaaaattgaaaaaaaaggagtacccaaagatagagactgtgaaggaagttgaagcctttacttttgctgatcatgaaatgggttccaatgaagttcatctgatagcaagacatgtcaccacatctgtggtcacatatttgaagaactttgaaactacaggtaaatgt

SEQ ID NO: 2403 - DNA, 21054 bp, Homo sapiens
atgaagtttcaactgtggtcctctcagatcaggcctctcggaccgattttcccagctctgcgggcgctctacgcgctggcgcgagccgcccctcaggaggccaccgcccttctggggccgctaccattggaagcctggaacgcggggggcggggctgaggtcgttgggctctggccattcctggtcaggtccggacagagggacaacggggtgctagagaaggagagcggggcgggtgaggaaggggctgagggggctgtgccggccatggagctgtacctcggcgcctgctccaagcctgccaaagtcgccgtcaccaagacggtcgccagcgtcctggccgcggacacccagcagtgcagagacggcgtgcacaaaacccactttgcaggggttggaccggctcagctactggacctacctctcggggtcaagctgcctgtgatcccaggaagcaatgctgtattctatactacgaatttcggtgaaaagctttttcgaccttcttatggttttaacctgactgatccctattgtcgacttttggaaaaccaatataaaagcctccatgatccacatttaaaagcatactataagcgcaaagatattttgaagagattaaagaaaggtggctacatcaccagcaataataaagttgtatgtaccttgagagaattgaataagtacaggcaatatcttaccagtttaaaattagactttgagagaaactatataaaagaacaaagaatacttgcaaaacaactacataacataccggaaaacaatcaaatccctcaacattgtgatgttgcacaagtccaaaactggttgttaaaggagggcactgaatctattaaggaccaggagcggctgatgaggcatagatatttggatatgataagtagaaaactagaacaacttgaacgcacagcagaagaacaacgcctattcctaatggatagagaagaaagacgacagcgggaacacacaagaagaaaacttactcttcgtagaaaaatagaagaggaatggaagacaaaagagatgttacttctgacaaggatggcagaagatgttaaaagagaagagaggatagaagaacaacagcatagaaacagagaagagagtgacaggaagaaacaagatcttctagagaaaaaaatggcttatcatttacaaaaaatgcaagatactggctttaacggagaagatataggaaaaaatacatttaaatacagaggtcaagatggaacacatgcttctccaaagaataaaaagaagacttctgaagatataatgttagtttatcctgctggagaccagaatacatataaagaaacacatggacatacagcaaatgctgctcatcagcgtcaaaatagttcaaataattttacgaaaaaaaactcagcttctgttgtttatcaggcagatgtacaggataatggtataaatcaaaagagagatgggatggtatctaaaaactcaagtattttcgatgatagaggaggtataaatatttcaggccaaggttcaattatttcagcgcaggtatcacccacgagaaatttttccagagtttcacaggcatttttggatccttcaaaagaagagaaggagacaaatgctgattgggatggaagaccaaccaagagatcaagctatctctgcgaatcaggacctcaggctcatgctacagacccgggtatattttcttctcctgtttacacaaatatgcaacagaacttgctgcaaaattgcttgcaagaaaaagtaacttctgaagaactgaatattataattcagaatgtaatgacctgggttgtggctacagtgaccagtatattgtacccagccatcacaaagtatgaaaaaagattgcaaaataatacatacccagtatctgatgactccatcctctcttcagatagttcaagtttctgtagcacgtgcagtgaagactttacatatagaagctacacatctgcaacaactaaaacatttcaggcagaaccctgtgcatttgtagttgacacgtcagtaaggagaccaaccacacctataaaacctcctcctgcacatgtggaaaaaacagttgtggggaaaacatgtcacataaaaggacaatctataatctctaaacataaatataataaaaccaacttgctatattcataccctaagctcagaagttgtaaatcagatagtcaccttttagcatcatttgaaacaggcacaaaaaaatctaaggatgctaccactgaaacagatagcttagggagttcattgcattgtgataaaacagcaaaagccatggatgaaatgaagaatttaaaaaatgtttttgttaactttaaatgttacttgaaaggggaaactgaagtgattttagaaagcattttgcgagaaataatgtctgatttaacccaggccattccctctctctcttctgttactgctgaagtttttgttgaacaatgtgaacgtgaaaaagaaatcttgctttccaatgctcatattccctcagttgcttctgagattgtggaaaatatgcttgagaagttagagtctgcagttgagaaaaaatgtgttgagatgttttcacaagatttgtcagtcgacattaaaccaagtttagcagccagtgatgaacttctcacatcatctaatggaaaacctttgaaaaattcaatgcctcatactttggacccaatgtgtgatattgcagaggacatggtgcatgccattttagaaaagctaatgactcttgtttcttttaagcaaaatgaatttcttcatcttaaagacacaaataagctttcctgccagcaacataagacagacccaatatgtatgttccttcaaagagctggcaaaaataaatctagtcttgaatctgatgaagctagtttaattgtcaatgaagaagtacaaaatttaatatcaaatattttttcccagtcttctttggttgcttatatagaggaagcaatcaatgctatactaggttatatacaaactgaactaaataatgagagaattattgcatctgaagaaaccgtagtactccttcagctacttgaggacatcctttttcagctccatcaggaaccagtaaatgaaagttttcaaaaaagtaggcaacctagaataagtagtccttctgacaccaaagaaaagtacagactcactggcactagattatcaaatagtcctaggtctggaagaccatttccacctataaatgttccaggcatggttctttattctgatgatgaaaatgaggaaatagacaatattgtaaaaaatgtgcttgattcaactttcaaagatgaaaaagtaaaatcacaagaacagattcctaatcattggtttacaaagggaaacacttgttttgaatgcaaaagaaatatcaaaccacctacaaagcctggttctagaagcaaagctgcatttcatgattgggaattaaagactgagccaccatctactaatcatgaagatattttaaagaaaaaactttcttcgaataaagacatttcaactttcagccaagatcaaaagcatcaaatagaaaaggcttcagaaaacatagtcacaagtattttaaaggaaatgctcaaggacatatcttccgttccttttggtcacttagacagcaaaactggcagtgaagcttcagttcttgtttcagaaaagcctcaaggactgtcacatcaagaatggatagaccagatgttttctgtttcagaaatcagtacagtggctcaagaaataacagattctgtgttaaacatacttcataaggcatcaaactacatttccaataccactaaaagttccatttcatcatcagttcatcagatttccttacataattctgacactgaacacatagtcaaagaagcaccaaataaatacccattaaaaacatggtttgacagtgaaaagaaaatgaaatatttatctttatttgacgttgatcctgaaaagcctccctggttaaaatctggaaaaagtgaacctaaacctgtagatgacattaatgataagatcattcgtacaatttttaaaagactgaagtcatttatttgtccaaaattgcatatgggcttcaaatcttcattacgatctcaacttagtaagtacacagctaaaatagtaaacattgttttatgtgctatccagaatgaactggaacttcacaaggaaaacctaaatcttagggagattgaccataccaaatcccttacagataaaggattttttgctaatactgataaaaaattagaatctcttgtcacgagtattgatgatgacattttggcgagtccattattaacctgtatttatgatatgttgttatcaagtgaaaatgcacatcaaagaagcatttcactctcttctcgtaagccaaagtctgcaactgacagtgttgatgtacaaagcattttgccaaataggcaagataaaaaatcttttcacaaatatttggctactccttgtactcaccacagtgtcaatggtggaaaccatattaaagagaatgcaaaattgcaagtgttagaaagaattggggaaacactacatgaaatgttaagcaagctcctggggacccatcttcattctcagctatcttgtagtcaacaaagcagagagatgaccaataagaatcagaaaatggctgctgcattgcagtctaatattcagttaatttctaaagcaattttggattatatccttgcaaaattatgtggtgttgacatggataccagttttgcaagttgtggattaaaagctatctcagagtctcttgacattgacaacccatcatttgcttcaattattgagaaaatggccaaatccaccaaaataatctccagcatagtttccagaagggttcaggaggacaataaagaagagactaaaagcaaggcaaaacctgttgctcctgtgtcttccaaaacaccaagcacaaaagaaatgcatccaaataaactaaaagctgtagcttcagatattcttaatatggtttttgctaaactggaagggtttgccaacggacatttagaaattttgggtgctattaatgatggaaataagaaaagcaataagataggctgggaatatgaaagcaccaatatttccagagacacacatgaagcatcatttctgtctgctttatatatgcatgcaaagaaggtatcaagtgctattttgaaggttattcaaacagaattaaatgtgacctcatcagatttgaagacaagtgtagaaaacccaccacctgagactcaaatacttaagtatgtagtcaagttaattttagatgcagtatcttccgatatgtttaatgaaatggaatctgaagggggaggcattgaaacttatcgatacaggccaacatatggaagtcttcctggaggagctgaatcagattcatttctagaagatgatgcatatacagcgaaaaaaattattgatgagagatccccacaaagagaagaagtgaaaacacgttctcttaaacaatgggctctcgaaaaaaccttaaacaaaattgaagtaaaactcaaagaaccacatatatctccaattgctcccattataagaaatattttgaatgaaatttttcaaagtactttaatcaatcaattaaatgtcctttctctctcccactctaattttaatggcatgcctcacaatgttgatgagccaactccccaaacatctgttcaatttatggataaaatgatggatcctttactttcggaagcagatataaccatagtaacagataatattgttaggactgtatttcacaaactttattcagctgccatgacagaaagaaatgtaagggaaaataggtataaaactatcactttttcagcaaatgtttcttctcatgaacacacctataaaggaaagtcctctgtcacggctttggatgaaaatccatgtacttttcagtctagattcagcgttgctgacaaggagacaaaggtaaatctagctgaagatattgtacaggcaatattaacaaatttagaaacttttgctacttccaaagtaaaatctctcttttattctcaagtcaactttacagttccagtggctttacctattcagcaagatcacagtacattgagcaaagcattatcagccaaagattcatattctgatgagcaattttcctgttgctcagtagatcataccaagtcaggaaagaccaacttgtgccaactgtctttgtctaaattaaatacttatgcactacaagtggctagaagaaatttacaaggaatcaaacaggaattagataaagaaagggaaaatccttttttaactcatgacattgggatttctgaaagtattgcaagtcaaattgttaacgcattgttagacattatatcacgtaaaggcaaatgtgacaaaaacagttctgacaaagagatcgatttagatcagcaaaaaggtgttattgaaaagctgctcaatgagaccaaatatcgaaaagtacttcaacttcaaatacaagataccattgaaggtatcctatgtgatatttatgaaaaaaccctgtttcagaataatctctcatttgccacacccactctgaaatgtagcatagctgataaacattcagaagaaaattctgaaatgttcatggagggtgcaaataagattattcctaagctttcagttcctaaatcagatgtcattttgatatccaatgatatagtgaatattgttcttcataatctcagttctgctgccacgcttgtcataaatgcaaagaatcctacttctgcaagattgcccctgacattttgtgatacgtttccaaaaatagactgtcaacagcctcttaaggggtcaaaaactgaaagaaaaacagagcgtttttcatattcaagaaatcagaaatcagcttatgctgatgataatcagataactgtagtagagaaagaagacactcagaaatctgctactgactcatgtgaggaaaatgctaacttcattactaaaactatttttaaacgtttggaatcttttgccacagaaagaatagattcattaattacccttgctttccaaagtaaagaaaagtcatttgttatcccagaattggaaaattgtaaacaaaatgacagcatcttttatgattcaagccaagtggaatcagatgtaaatgtcctgaaaatatcagcaactgaaaccattctcagccaagagcttacagatttcacttttgttggtcgcagagaaaaacttggatccacaattcacctatcgcaagctaggcttaagacatatgctgacgtcattgccagtgccattttgaagcttattaaaaatgacttagacttagaaattcaaaagatatatccatatcaaaacaatattttgttccaagaaaacatcattgtgagtgaaattgttgacagtatgttaaagatgttagatgataaaagatctgtaaaggaaatttgttttaattcaaaagaaaattctaacttttcacaattagctttatcaaatgaaatattgctgggtcacaaagagaaggaaagaagtaccaaacaatctctatttacaaagtatccattagagcaaaaccaaatgatattggaaaacaaaaggcagataattgttttggaagaaatatttatgagaaatggagaatcaaaaaacaaagaaaaaggtgaactgctcattgcagtggaagaacttttgaataagttgtatcaaagagtaagggaagtcacaggccatttgcctccacttaatgaaactgccaactttatatctaattctaagattaaaacatcagacacaacacagaaaaacagttttcaatcacatattaacagtgtagcaaatgacatagttgaaagtgttttggggaaaatgtacttggtagttgtgacatcattatatgaaaataataaaagtaggacagaagttgaaatatctgaccacaatgattccttactaatgaaaccattaaggtttagagaaactaaacaagcaggaaaaataagtaattcccctagatatgcgatatcacaggcttattcttatgtcgacagtcaaaatatctctgtgatggaaaacactcttttgccatatttaccattgcaagtgaagaaagacttaattcaaatggttctcaataagatcacaaattttgtctcacttcctttaaaggtgagccctaaggacaaccctaagccatgctttaaagcacatttaaaaacaagatcaaaaattaccactttgcctaaatttacaaaaaaaacacacttaggactgagtgctgctaaggccaaaagcaaaaccaagttaggtcctggagagaagaccctaaaagacagcagatccaagactgccattgggttgtcacacatcatgtcagctggagatgccaaaaatttactggacacaaaattgcccacttcagaactaaaaatatatgccaaggatataataattaacatcctagaaacaattgtgaaggaatttggaaaggtaaagcaaaccaaagctttaccatctgatcaaatcatagcagcaggtaaaatagttaatacagttttgcaagaattatatgttaccaataactgcaatttggcttacccgatgaaatcctcacatctcagactttcacaggggaatataggcacaggatcccttcctaaacaacaagcatgtttttacttggagaatgtttcttcacagctagagcacatttttcctagagaaggtatatttaaaaaattgtttgacaagtggcaaacagaatcaaatgacaaggaaaatgaaaaatgtaagctattgatgatagctgaaaatgttttgactgaaatttcaataaaagcaaaagaattagaatattctctttcacttttaaatttgccccctcttgagaattgtgaaagcaggttttataatcattttaaaggagcttctactagagccgaggatactaaagcacaaattaatatgtttggaagggaaattgttgaaatgctacttgaaaaactacagctatgctttctgtcccaaattcccactccagatagtgaagaaactctatcaaacagtaaagaacacattactgctaaaagtaaatatggttttccaaacaagcatagcctcagcagtttaccaatctataacacaaagacaaaagaccaaatttctgtgggctccagcaaccaaattgttcaagagattgtagaaacggttttaaacatgttagagtcatttgtggacttgcagtttaaacatatctccaaatatgagttttctgaaattgtgaaaatgcctatagaaaacctttcttctatccaacagaaactgttaaacaaaaaaatgttgccaaaattacaaccactgaaaatgttttctgataaatccgagtcaaatactattaatttcaaggaaaacatacagaatatccttctacgggttcattcattccattcacaattacttacatatgctgttaatatcatcagtgacatgcttgctgtaattaagaacaagctagacaacgaaataagccaaatggaaccatcttcaattagcatattgaaagagaacattgtagcaagtgagatcattggcacactaatggaccagtgtacttatttcaatgagtctttgatacaaaacctttcaagagaaagtttgttccaaggagctgaaaatgcctacactgttaatcaggttgaattagcaactaatatgaaaatgttcacatcaaagttaaaggaaggtagtttggggattaatccttcacaagtgagtaaaactgggtttgtgttttgttcagatgaagatatgaaagaaaagtacagggtttcatcagatttacccacctctgtcagatcctctgtagaagacacagttaaaaactcagagccaacgaaaaggcctgattcagaaactatgccatcgtgttctactagaaacaaagtacaagaccacagaccaagggaatctaactttggtagttttgatcagaccatgaaaggaaatagctacctccctgaaggcagtttcttacaaaagctgcttaggaaagcaagtgactccacagaagcagcattaaagcaagtcttgtcattcatagaaatgggaaaaggtgaaaatctaagagtgtttcattatgagaacctaaaaccagttgttgaaccaaaccaaattcagacaaccatttcccctctcaaaatatgtttagctgcagaaaatattgtcaatactgtgctatccagctgtggctttccaagtcaaccacacactaatgagaacagggaaataatgaaaccatttttcatatcaaaacaaagctctttatctgaagtatctggagggcaaaaggataacgaaaaaagtttgcttagaatgcaggataaaaaaatcaactatatacctgaggaagaaaatgaaaaccttgaagccagccgggaagattcttcttttttgcaaaaattgaaaaaaaaggagtacccaaagatagagactgtgaaggaagttgaagcctttacttttgctgatcatgaaatgggttccaatgaagttcatctgatagcaagacatgtcaccacatctgtggtcacatatttgaagaactttgaaactacagtttttagtgaggaaaagatgtctgtttctacatggtcaaggaaaaaatatgaatcaaaacagttcctaagaaacatatacgatgattcttcaatttatcaatgttgtgaacatctcactgagtcagtactttaccatttaacttcgagcatttctgatggcaccaaaaagggtagagaaaaagagaaagcatgggaaattcaagaagcaacatttagcaagattatttcaattcattctcaagtgtttgagagcaggtcaatttccattggagaacttgctttatgtatttctgaaatcattattaaaattctttttaataataaaattatacaggctgacattgcacagaaaatggttgccatacctacaaaatacacttactgtccaggaatagtttctggtggctttgatgacctctttcaggatctcttagtaggagtgattcatgtactgtccaaagaaatagaagtagattatcactttgaaagcaatgtaagaaacaaatcattttctatgcatagaaataatagtgtacccctttgcaacaaaatcaatagacaggcaagccccagagactggcaattttctactcaacaaattggtcaactttttcaaaaaaataagttaagttatcttgcatgtaagttaaacagcctggttggtaacctaaaaacaagtgaatccaaagaagtagtcaataaagtttttaatattgtttcagatttattttcaccagatgaatgcctagatacgggtatggattctggtaaaatacaaagaacatatttctactcctcgaataatgagcaacctaatagcatacttaccaataacctacagctctcctcaaaatcagtttttcttctcaatgttgtatgtgagaaacttatcagaatacttttggaagaatgcacaagcactgcttttcctgataaagggtctgtttcagaggaaacatcagcagaagaatgtcaacttttaaaaatgcttcaaagtgtagaagatggaaaatctgattatcgtaagggaggaatggactgtgaatgccttcaagtagattacatgtcagaccttttggagaatgtggcagaaattgatcaagacttattgacatcagactctatgcttactattatttcccacagcttggttaaatcattgatggacaaattatctcacagcatacaacaagctccggaaagtctaccttttgcaaataagcatttgaactacagaacaagagaaatacagtctagtttcataaaagcaagaaagtcagaattaatagaattaggacagagtaaaagttctttagaactcaggagctatgatagtaattctttgacagtatccctgaataatcccagtgtggttagctccaaaatacaagcaccatttaacaagcattgtgcagtaaaatcctcttctgtgtcaccttttgaaagacagagaacaaaggaaatggataaggtagccattcataataagctacatcaggaaggtatatatgctggtgtttattcagccacatttttggaaggaataatttcagaattgttttttaatctctctatgtcattgtggggcaaaaataaaaacatcactgtgtcctggctcaatgagatgaatacattatttgtcaacaatgtagtgaatgaatttaataatgctcaagtcactgttctacggaatgctgaagaaaggctgtgttttccaccagttcatacagaaactgttagcaaaattgttgactcagtttattatgatgttttacagcagtatgaattaaaagtggcctgtggtaataatccggtatacgacaatgcctcaatagcagaacaaataacaaatggcatattgttagagattttagactacaaactgccatcttgcttcaaggaacatctcataccccattcatattaccctctcaaacctgaaattatattgcaaaagcttcaaagtaacctaacagaatttacttctctacccaggtcttcatcagactatagtaccatgttatcacattcatttttagaagatgtcataagaaggcttttatctcagctaattcctccacccattacatgttcctctttaggaaaaaaatatttaatgagttctgattttaatgaaatgtccacttgtataataaataaggttatgtcagccatttcaaaacataaaatctggttcactatatatgataatcaatatctatatactggaaaaaacctccaaaagatggtggattctgtatattgtaatattttgcaaatgtctgactctcttgtttcaatacaaaaaagtatagtaagccgaagcccaattatgattgaccaaatagccagctttatcatccaagagattatcgaaaatcatcttcaaccatttttgagtggagaggttttatgtcatccaaggactccactggatccagtgtctactattgttacacaggttctgagtgaagtgatagagtcacacagacctcagaagcaatcacctttagatattcaccttgattcatttgtaagggagattgttgccagacttttgtcaaagattttcagcccaaagcataacactgaaattgagttgaaaaacatgacccaaagaatagtaaactccataaataggcatttcaataaagctaaaattcacattctctatgatgacaaagaacaggctttcttttctttcaatacagatattgtggatgaacttgccacctcagtttatagaaatgctttaaagcagcatgggctagaccttgctgttgataaagagtctgaagacagtggcatttttgtggaaaatattaccaatttaattgtagcagctatttcagattaccttcttcatccactgttttctggggatttttcagcttctacctattctaattcagtggctgagaatattgttcaggacatccttagtaacatcagtaaatctactgagccaagccagagtgtacctctatataacaccttgctgccatacacatttttagaagatatgatcagagtactattatctaaattattttcttctgcatctagcctggttctaaacagagacacccaaaaagatatatcaagagtgaatttcaatgacattgcttcaaacctagttagtgatattaggatgaaagtttcccaacatgaaattcgattttcaaaagaggaagaagaaaccaagtttatttattcagaagatgatattcagcaccttgttgattcagtatttgcaaatgttgtgcaaacctctggttctcaagaatcagctgtgcaaaatatcacaagcagtaatgacattcttatagatagaatagcaggtttcatcattaaacatatctgtcaaaaacatcttcagccatttgtgagtggaaaatcattatcttcatcagacacatattttgatgatgagagaaggcagttattttataccagtgtttactcttcaacattcttggaagatgtaatctctggggttttaagaaaaatattccacagggtagtaggcattgtacaaacaaaatccataagagattcagaagatgaactgtttgagaaagctgaagaactcatacatttgattacaggggaattctcaaaagcccaagttagcattatagataatactgaggaaagactgtgtttacctccagtggagagggatgtagtcaaaacaattgttgacatggtgtacagcaaagttttgcaagaatatgaaatggaagtcgtgcccaataaagattttctaaatgacacaaagacattggctgcaagaataactaatatcatcctggctgaaatttttgatttccaaattcatccagatcttatagcaaatctgccttttaaatcacattccaaactcagtgcaaatgttttaatacaaagagttcaatatgatataagtaaatcaagattccaaagacaagcttcaacaatgtataccactatgttatcacatagtcatttggaaaaaatagttactcagcttacatctcagataagtccattgaacaccagtgcagagcagtcagatactactaaatcagacttaagtaatacagtgataaaactgataaatgaaattatgtcaataatttcaaaacatgaaatatgtattattaaatatgggaataaaaaacagagtatgatttcagcaaaagatatccagtctatggttgattccatttatgctgatctttctcattcaaatatataccagtccattacaaaagataaaaagagcataagtgacatacctgtttcaaaaatagcgagttttataataaaagaaatctttaaccatcatattcaatcatttttatctgaagataaaactctccttttggcagcagttgatcaaacttataaattgaaagcaatagatcctaaacaaagagaattatcttttattgtgaactcatctgtctttttggaggaagtaatttctgagctcttatgcaaaattctttatgcattttcacataacatgttggttactgaaaatccagatagagtgaaactgaaacttaccaggattgttacaacattggtaaattcaattgttctggagttcaccacatcagagattttagttgcagataactttgataaaaatttgtgtttctcagaaagatacaaagaaatggttcaaaaaatagtcaactcagtatatggaaaagtattagatcaatataaatctctgattcaaatacatagggttatacaaagtgacacaatatgttttggtaggaaaatatattatttgctattggaagaaatatatgattatcaagtgcagtcattagtttcaggagaattagagtcttcttcttattcgtatccccaagctgataatatcatcagaaatgtgcttaacataatcacaaaggatagccatgccttgccaccatatattactgtgttgcctcattctcttttagaagatatggtttacaggcttctagggcatgtcttcccttcaactcacactgaaaatgaactaaaagagaaaaagtttccaccggatgatgaatttgtggaggcagcttcaaaattgactgatgaaattataaaagaaatttctgaacatgagattcgactttccatggcagaggataatgcagaaagtatgcagttagaacctattgaaaatttggtcgactccatatgtaataatattttgaaaacatctgaattccaagctgaagtacaaaaagatgcagacaaaaaaggatgctcattcctcagtaaattagctggttttattatgaaagaaatcatgtatcatcatttacagccatttttacatggtgaagaatcatctttcagtgacttatctgattatgaccatgtctctgaacttgctaaatctggtaaagaaaagacacagccttctctctattcagctacatttttggaagacataatcattgaccttgttcacaaattttgttctctcctcattattactgaagattctaagaaaaatgaaatggcagagctagatattatgggcttggctctaaaacttgcaaattctctgataagggaatttaagaaaagtgatattaaagttttaccaaatgctgaaaaaatgttttcttttccaccaattgataaagagacagttgataaaatatccaattttgtatatgaacagttcatagaaaaatgcacatctcatgatattcaaaaaggtgatgaaagtaacattgctatagggatgattgctgctctaacccagaaggcaatatctgcattcaggattcaaccacttttttcaggagactggtcttccaccttcttttcatttctaaatccagataatatcacccaaagggttcaacacctaccacaaaacacctttacacaaataagcagatgtgcaaaagagaaccaactttctttaccagatcaatcatataaagatacttcttccaccccagattgcaaaaacatgatgagcactttggaaataaatagaggtacaatgaatagaaagaaaagttttaaaaccaaggacacatcagtgaaaaaaggtgacatccaaaatccagtacttagctctataaatgcaattatgaaaagcggcatgattaacctaacatcagggttggctacaggtgtgacaaataaaaaggaagtggatgaaaataaagtgggaatttgtactcaaaaacatagtgagaatgtatcaaaagttacttcaactaccactgtgaaaagtaaagatactcaggagccaaatttgagtgaaacatttaataataatgaaattgagaagaaaagaaatttaattccaacagataaaaaagggaaagatgatgagatatacacacatttttcattaataattgatgatacagaatatgagaaggaagtacttggatcagattctgaaataggctataaaaagaagattgacaatgcaagggaaagctcatttaaaaaagatgacaagctctttcagttatcctccttgaagtccaagagaaatctagggactacaacagatactttggaaataagaattcgaacatcaagcaatgaggggagaagagactctccaacacaaacgtgtagggatgaggaacaccactcagattatgaacatgttcaaaatgtcattgaaaatatttttgaagatgttttagaactatcttcttctccagaaccagcatattattcgaaactcagttatgaccaaagccccccaggtgataatgtattaaatgtaattcaagagattagcagggattcggcacagtctgttacaacaaaaaaagtatcctcctcaactaacaaaaatatctctgccaaagaaaaagaagaggaagagagagaaaaagagaaagtaagagaggagattaaaagtgaacccagtaaaccagatgatcctcaaaaccaacgagaaagtaaacctggaatttttcccgctaagtttttagaagatgttattactgagatggttaaacaattgatcttttcttctataccagaaacacaaatacaagatagatgtcaaaatgttagtgataagcaaaatcaagccaaactctatgacactgctatgaaactcatcaattcactgttaaaggagttctcagatgctcaaattaaggttttcaggccagataagggaaatcagttccctgggggtaaagtgtcttcagttcctaaagtacctccaaggtataaagagccaactacagatgaagcaccatccagcattaagataaaatctgcagataaaatgccacctatgcataaaatgatgagaaaaccttcttcagataagataccatcaattgacaaaacattggtcaataaagttgttcactcctctgtttgtaatattttaaatgactatggatctcaagactctatttggaagaatataaacagtaatggagaaaatttagcaagaagactaactagtgcagtgataaatgaaattttccaacgtcaggttaacttgatattttgtgatgaggtttcagtttcagcatgtttgcctctggaatctaaggatgttgttaaaaaggtccaaaagttggcccaaacagccagcaaagaatgtcaaacttcatcaccatatacaataatattacctcataaatttttggagaatgtgatttctgctcttttctccaaaattttctcaacaatatccagcacaaaaacaaaagaacctgaggacaatttgtccacagaactgaatttccttcaaatgaagttagtaagtgcagttgcaacagagatctcccaagataaatatatgactatacagtatgtagaaaccttacaatctgatgatgatgaaattattcaattagtggttcagtctgtttataataatctcttgccacagtttggatcacaagagattatacaaaattgtgtaaccagtggatgcaaaatcctttcagaaaacatagttgacttggttctacgagaagtggctagcaatcagctgcagagctatttttgtggagagctaactccacatcagtgtgtggaagttgaaaacatcgttgaaaagatccttaaagatgttttccaaactactgatgtgcccctacctaaaccttcacatgctgataagctgtcttataacataatagaagaaattgctgtgaaatttttatcaaagcttttatctatatttccaaaagtacataaagaaagaacaaaatctctagagactgatatgcaaaaaataacttcaaaagtactaaattcagtccaagaatttatctccaaaagtaagattaaacttgtaccacccaccaaggaatcacctactgtgcctgtagctgataatgcaactattgaaaacatagttaattctatttataccagtgttttaaagcactctggctcttatacttctgtatttaaagatttaatgggtaaaagcaatgtcctctctgatacaataggctttttaatggtgaatgcaatttcgaattctgaatttcaacctcaagtagaggaagaagtatcaaattcagaattagttctggaagctgtcaaaattatggaaaaagtgatcaaaattattgatgaacttaagtctaaggaaaagtcttcatccagaaaaggtttgacattagatgccaaacttttagaagaggtgttggccttgttcttggctaaactaataaggttgccaagttcctcaagcaaagatgaaaaaaacttatcaaagactgagttaaataaaattgcatctcaactgtcaaaattggtaacagctgaaatttccagaagtagcattagtctaatagcttctgatcctgaagagcactgtttaaatccagaaaatacagaaaggatttatcaggttgtcgattccgtttatagtaacatactgcaacaatcaggaaccaacaaagaattttattatgatataaaagatacaaatacagcctttcctaaaaaagtggctagtttaattattgatggagtttcaagttttccattagatacaattaactcaacaatttcaaatgctgatctctctggagagctagacgttaatagaattgttcaaaaggcccaagaacatgcttttaatgtgattcctgaattagagcaagaaaagttagatcaaaatttatctgaagaggaatctccaattaaaatagttccacatgttggaaaaaaaccagtcaaaatagatccaaaaattatttcagaacacttagcagttatttctataaaaactcaacctcttgagaaacttaagcaggagtgtttgaaaagaactggacatagcatagcagaactgagaagagcatcaataagtgggagaaattactccttaggatcacctgatttagaaaagagaaagacagaaagacgtacctcattggataagactggaagactggatgtaaaacccctagaggccgttgctagaaattcatttcagaatataagaaagcctgatattacaaaggtggagctcttaaaagatgttcaaagtaaaaatgatcttattgttcgattagtagctcatgatattgatcaagtgtatttggaaaattacataaaagaggaacgagattctgatgaagatgaagttgttttaacacagacttttgcaaaagaagaaggcatcaaagtatttgaagatcaagtgaaagaagtcaagaagccaatacaaagcaaactttctcctaagtcaacactaagcacgagcagcctgaaaaaatttttgtcactaagtaaatgttgtcagaccacagccagtgcaaatattgaaagtactgaagcaatctcaaatcaggtaatagaatccaaggagacacatgttaaaagagctgttgctgagcttgacatggccacaccaaagacgatgcctgaaacagcctcttcatcttgggaggaaaagccccagtgtaagaaagaagaaaagaatcttgttactgaaccaacacattacttcatacacagaattatgagttcatcttcatacaaccaagaagatctcatttcatctactggtgaggctgaagattgtcactcagacccaagtgctaaaatattagaagaaagttctcaggaacaaaagccagagcatggaaacagtgttaagtttatcaccatctttgaaagatccaaggatgttcttggcagtgcaaatccctcaaaggaagtcatttcagaaactcccaagcccgatgtctccaaacaaggatctaaaatgctgacaaaaatgtcttcaactttgtcaaaggtgttttctcaatgtaacaccaatatttccagatcttcctcaccagctcaccaggatgaacactgaagcttttgtacctgatataagtatgcttacttcttttagaaaataaaatggtttttaaagcat

SEQ ID NO: 2404 - DNA, 20788 bp, Homo sapiens
atggagctgtacctcggcgcctgctccaagcctgccaaagtcgccgtcaccaagacggtcgccagcgtcctggccgcggacacccagcagtgcagagacggcgtgcacaaaacccactttgcaggggttggaccggctcagctactggacctacctctcggggtcaagctgcctgtgatcccaggaagcaatgctgtattctatactacgaatttcggtgaaaagctttttcgaccttcttatggttttaacctgactgatccctattgtcgacttttggaaaaccaatataaaagcctccatgatccacatttaaaagcatactataagcgcaaagatattttgaagagattaaagaaaggtggctacatcaccagcaataataaagttgtatgtaccttgagagaattgaataagtacaggcaatatcttaccagtttaaaattagactttgagagaaactatataaaagaacaaagaatacttgcaaaacaactacataacataccggaaaacaatcaaatccctcaacattgtgatgttgcacaagtccaaaactggttgttaaaggagggcactgaatctattaaggaccaggagcggctgatgaggcatagatatttggatatgataagtagaaaactagaacaacttgaacgcacagcagaagaacaacgcctattcctaatggatagagaagaaagacgacagcgggaacacacaagaagaaaacttactcttcgtagaaaaatagaagaggaatggaagacaaaagagatgttacttctgacaaggatggcagaagatgttaaaagagaagagaggatagaagaacaacagcatagaaacagagaagagagtgacaggaagaaacaagatcttctagagaaaaaaatggcttatcatttacaaaaaatgcaagatactggctttaacggagaagatataggaaaaaatacatttaaatacagaggtcaagatggaacacatgcttctccaaagaataaaaagaagacttctgaagatataatgttagtttatcctgctggagaccagaatacatataaagaaacacatggacatacagcaaatgctgctcatcagcgtcaaaatagttcaaataattttacgaaaaaaaactcagcttctgttgtttatcaggcagatgtacaggataatggtataaatcaaaagagagatgggatggtatctaaaaactcaagtattttcgatgatagaggaggtataaatatttcaggccaaggttcaattatttcagcgcaggtatcacccacgagaaatttttccagagtttcacaggcatttttggatccttcaaaagaagagaaggagacaaatgctgattgggatggaagaccaaccaagagatcaagctatctctgcgaatcaggacctcaggctcatgctacagacccgggtatattttcttctcctgtttacacaaatatgcaacagaacttgctgcaaaattgcttgcaagaaaaagtaacttctgaagaactgaatattataattcagaatgtaatgacctgggttgtggctacagtgaccagtatattgtacccagccatcacaaagtatgaaaaaagattgcaaaataatacatacccagtatctgatgactccatcctctcttcagatagttcaagtttctgtagcacgtgcagtgaagactttacatatagaagctacacatctgcaacaactaaaacatttcaggcagaaccctgtgcatttgtagttgacacgtcagtaaggagaccaaccacacctataaaacctcctcctgcacatgtggaaaaaacagttgtggggaaaacatgtcacataaaaggacaatctataatctctaaacataaatataataaaaccaacttgctatattcataccctaagctcagaagttgtaaatcagatagtcaccttttagcatcatttgaaacaggcacaaaaaaatctaaggatgctaccactgaaacagatagcttagggagttcattgcattgtgataaaacagcaaaagccatggatgaaatgaagaatttaaaaaatgtttttgttaactttaaatgttacttgaaaggggaaactgaagtgattttagaaagcattttgcgagaaataatgtctgatttaacccaggccattccctctctctcttctgttactgctgaagtttttgttgaacaatgtgaacgtgaaaaagaaatcttgctttccaatgctcatattccctcagttgcttctgagattgtggaaaatatgcttgagaagttagagtctgcagttgagaaaaaatgtgttgagatgttttcacaagatttgtcagtcgacattaaaccaagtttagcagccagtgatgaacttctcacatcatctaatggaaaacctttgaaaaattcaatgcctcatactttggacccaatgtgtgatattgcagaggacatggtgcatgccattttagaaaagctaatgactcttgtttcttttaagcaaaatgaatttcttcatcttaaagacacaaataagctttcctgccagcaacataagacagacccaatatgtatgttccttcaaagagctggcaaaaataaatctagtcttgaatctgatgaagctagtttaattgtcaatgaagaagtacaaaatttaatatcaaatattttttcccagtcttctttggttgcttatatagaggaagcaatcaatgctatactaggttatatacaaactgaactaaataatgagagaattattgcatctgaagaaaccgtagtactccttcagctacttgaggacatcctttttcagctccatcaggaaccagtaaatgaaagttttcaaaaaagtaggcaacctagaataagtagtccttctgacaccaaagaaaagtacagactcactggcactagattatcaaatagtcctaggtctggaagaccatttccacctataaatgttccaggcatggttctttattctgatgatgaaaatgaggaaatagacaatattgtaaaaaatgtgcttgattcaactttcaaagatgaaaaagtaaaatcacaagaacagattcctaatcattggtttacaaagggaaacacttgttttgaatgcaaaagaaatatcaaaccacctacaaagcctggttctagaagcaaagctgcatttcatgattgggaattaaagactgagccaccatctactaatcatgaagatattttaaagaaaaaactttcttcgaataaagacatttcaactttcagccaagatcaaaagcatcaaatagaaaaggcttcagaaaacatagtcacaagtattttaaaggaaatgctcaaggacatatcttccgttccttttggtcacttagacagcaaaactggcagtgaagcttcagttcttgtttcagaaaagcctcaaggactgtcacatcaagaatggatagaccagatgttttctgtttcagaaatcagtacagtggctcaagaaataacagattctgtgttaaacatacttcataaggcatcaaactacatttccaataccactaaaagttccatttcatcatcagttcatcagatttccttacataattctgacactgaacacatagtcaaagaagcaccaaataaatacccattaaaaacatggtttgacagtgaaaagaaaatgaaatatttatctttatttgacgttgatcctgaaaagcctccctggttaaaatctggaaaaagtgaacctaaacctgtagatgacattaatgataagatcattcgtacaatttttaaaagactgaagtcatttatttgtccaaaattgcatatgggcttcaaatcttcattacgatctcaacttagtaagtacacagctaaaatagtaaacattgttttatgtgctatccagaatgaactggaacttcacaaggaaaacctaaatcttagggagattgaccataccaaatcccttacagataaaggattttttgctaatactgataaaaaattagaatctcttgtcacgagtattgatgatgacattttggcgagtccattattaacctgtatttatgatatgttgttatcaagtgaaaatgcacatcaaagaagcatttcactctcttctcgtaagccaaagtctgcaactgacagtgttgatgtacaaagcattttgccaaataggcaagataaaaaatcttttcacaaatatttggctactccttgtactcaccacagtgtcaatggtggaaaccatattaaagagaatgcaaaattgcaagtgttagaaagaattggggaaacactacatgaaatgttaagcaagctcctggggacccatcttcattctcagctatcttgtagtcaacaaagcagagagatgaccaataagaatcagaaaatggctgctgcattgcagtctaatattcagttaatttctaaagcaattttggattatatccttgcaaaattatgtggtgttgacatggataccagttttgcaagttgtggattaaaagctatctcagagtctcttgacattgacaacccatcatttgcttcaattattgagaaaatggccaaatccaccaaaataatctccagcatagtttccagaagggttcaggaggacaataaagaagagactaaaagcaaggcaaaacctgttgctcctgtgtcttccaaaacaccaagcacaaaagaaatgcatccaaataaactaaaagctgtagcttcagatattcttaatatggtttttgctaaactggaagggtttgccaacggacatttagaaattttgggtgctattaatgatggaaataagaaaagcaataagataggctgggaatatgaaagcaccaatatttccagagacacacatgaagcatcatttctgtctgctttatatatgcatgcaaagaaggtatcaagtgctattttgaaggttattcaaacagaattaaatgtgacctcatcagatttgaagacaagtgtagaaaacccaccacctgagactcaaatacttaagtatgtagtcaagttaattttagatgcagtatcttccgatatgtttaatgaaatggaatctgaagggggaggcattgaaacttatcgatacaggccaacatatggaagtcttcctggaggagctgaatcagattcatttctagaagatgatgcatatacagcgaaaaaaattattgatgagagatccccacaaagagaagaagtgaaaacacgttctcttaaacaatgggctctcgaaaaaaccttaaacaaaattgaagtaaaactcaaagaaccacatatatctccaattgctcccattataagaaatattttgaatgaaatttttcaaagtactttaatcaatcaattaaatgtcctttctctctcccactctaattttaatggcatgcctcacaatgttgatgagccaactccccaaacatctgttcaatttatggataaaatgatggatcctttactttcggaagcagatataaccatagtaacagataatattgttaggactgtatttcacaaactttattcagctgccatgacagaaagaaatgtaagggaaaataggtataaaactatcactttttcagcaaatgtttcttctcatgaacacacctataaaggaaagtcctctgtcacggctttggatgaaaatccatgtacttttcagtctagattcagcgttgctgacaaggagacaaaggtaaatctagctgaagatattgtacaggcaatattaacaaatttagaaacttttgctacttccaaagtaaaatctctcttttattctcaagtcaactttacagttccagtggctttacctattcagcaagatcacagtacattgagcaaagcattatcagccaaagattcatattctgatgagcaattttcctgttgctcagtagatcataccaagtcaggaaagaccaacttgtgccaactgtctttgtctaaattaaatacttatgcactacaagtggctagaagaaatttacaaggaatcaaacaggaattagataaagaaagggaaaatccttttttaactcatgacattgggatttctgaaagtattgcaagtcaaattgttaacgcattgttagacattatatcacgtaaaggcaaatgtgacaaaaacagttctgacaaagagatcgatttagatcagcaaaaaggtgttattgaaaagctgctcaatgagaccaaatatcgaaaagtacttcaacttcaaatacaagataccattgaaggtatcctatgtgatatttatgaaaaaaccctgtttcagaataatctctcatttgccacacccactctgaaatgtagcatagctgataaacattcagaagaaaattctgaaatgttcatggagggtgcaaataagattattcctaagctttcagttcctaaatcagatgtcattttgatatccaatgatatagtgaatattgttcttcataatctcagttctgctgccacgcttgtcataaatgcaaagaatcctacttctgcaagattgcccctgacattttgtgatacgtttccaaaaatagactgtcaacagcctcttaaggggtcaaaaactgaaagaaaaacagagcgtttttcatattcaagaaatcagaaatcagcttatgctgatgataatcagataactgtagtagagaaagaagacactcagaaatctgctactgactcatgtgaggaaaatgctaacttcattactaaaactatttttaaacgtttggaatcttttgccacagaaagaatagattcattaattacccttgctttccaaagtaaagaaaagtcatttgttatcccagaattggaaaattgtaaacaaaatgacagcatcttttatgattcaagccaagtggaatcagatgtaaatgtcctgaaaatatcagcaactgaaaccattctcagccaagagcttacagatttcacttttgttggtcgcagagaaaaacttggatccacaattcacctatcgcaagctaggcttaagacatatgctgacgtcattgccagtgccattttgaagcttattaaaaatgacttagacttagaaattcaaaagatatatccatatcaaaacaatattttgttccaagaaaacatcattgtgagtgaaattgttgacagtatgttaaagatgttagatgataaaagatctgtaaaggaaatttgttttaattcaaaagaaaattctaacttttcacaattagctttatcaaatgaaatattgctgggtcacaaagagaaggaaagaagtaccaaacaatctctatttacaaagtatccattagagcaaaaccaaatgatattggaaaacaaaaggcagataattgttttggaagaaatatttatgagaaatggagaatcaaaaaacaaagaaaaaggtgaactgctcattgcagtggaagaacttttgaataagttgtatcaaagagtaagggaagtcacaggccatttgcctccacttaatgaaactgccaactttatatctaattctaagattaaaacatcagacacaacacagaaaaacagttttcaatcacatattaacagtgtagcaaatgacatagttgaaagtgttttggggaaaatgtacttggtagttgtgacatcattatatgaaaataataaaagtaggacagaagttgaaatatctgaccacaatgattccttactaatgaaaccattaaggtttagagaaactaaacaagcaggaaaaataagtaattcccctagatatgcgatatcacaggcttattcttatgtcgacagtcaaaatatctctgtgatggaaaacactcttttgccatatttaccattgcaagtgaagaaagacttaattcaaatggttctcaataagatcacaaattttgtctcacttcctttaaaggtgagccctaaggacaaccctaagccatgctttaaagcacatttaaaaacaagatcaaaaattaccactttgcctaaatttacaaaaaaaacacacttaggactgagtgctgctaaggccaaaagcaaaaccaagttaggtcctggagagaagaccctaaaagacagcagatccaagactgccattgggttgtcacacatcatgtcagctggagatgccaaaaatttactggacacaaaattgcccacttcagaactaaaaatatatgccaaggatataataattaacatcctagaaacaattgtgaaggaatttggaaaggtaaagcaaaccaaagctttaccatctgatcaaatcatagcagcaggtaaaatagttaatacagttttgcaagaattatatgttaccaataactgcaatttggcttacccgatgaaatcctcacatctcagactttcacaggggaatataggcacaggatcccttcctaaacaacaagcatgtttttacttggagaatgtttcttcacagctagagcacatttttcctagagaaggtatatttaaaaaattgtttgacaagtggcaaacagaatcaaatgacaaggaaaatgaaaaatgtaagctattgatgatagctgaaaatgttttgactgaaatttcaataaaagcaaaagaattagaatattctctttcacttttaaatttgccccctcttgagaattgtgaaagcaggttttataatcattttaaaggagcttctactagagccgaggatactaaagcacaaattaatatgtttggaagggaaattgttgaaatgctacttgaaaaactacagctatgctttctgtcccaaattcccactccagatagtgaagaaactctatcaaacagtaaagaacacattactgctaaaagtaaatatggttttccaaacaagcatagcctcagcagtttaccaatctataacacaaagacaaaagaccaaatttctgtgggctccagcaaccaaattgttcaagagattgtagaaacggttttaaacatgttagagtcatttgtggacttgcagtttaaacatatctccaaatatgagttttctgaaattgtgaaaatgcctatagaaaacctttcttctatccaacagaaactgttaaacaaaaaaatgttgccaaaattacaaccactgaaaatgttttctgataaatccgagtcaaatactattaatttcaaggaaaacatacagaatatccttctacgggttcattcattccattcacaattacttacatatgctgttaatatcatcagtgacatgcttgctgtaattaagaacaagctagacaacgaaataagccaaatggaaccatcttcaattagcatattgaaagagaacattgtagcaagtgagatcattggcacactaatggaccagtgtacttatttcaatgagtctttgatacaaaacctttcaagagaaagtttgttccaaggagctgaaaatgcctacactgttaatcaggttgaattagcaactaatatgaaaatgttcacatcaaagttaaaggaaggtagtttggggattaatccttcacaagtgagtaaaactgggtttgtgttttgttcagatgaagatatgaaagaaaagtacagggtttcatcagatttacccacctctgtcagatcctctgtagaagacacagttaaaaactcagagccaacgaaaaggcctgattcagaaactatgccatcgtgttctactagaaacaaagtacaagaccacagaccaagggaatctaactttggtagttttgatcagaccatgaaaggaaatagctacctccctgaaggcagtttcttacaaaagctgcttaggaaagcaagtgactccacagaagcagcattaaagcaagtcttgtcattcatagaaatgggaaaaggtgaaaatctaagagtgtttcattatgagaacctaaaaccagttgttgaaccaaaccaaattcagacaaccatttcccctctcaaaatatgtttagctgcagaaaatattgtcaatactgtgctatccagctgtggctttccaagtcaaccacacactaatgagaacagggaaataatgaaaccatttttcatatcaaaacaaagctctttatctgaagtatctggagggcaaaaggataacgaaaaaagtttgcttagaatgcaggataaaaaaatcaactatatacctgaggaagaaaatgaaaaccttgaagccagccgggaagattcttcttttttgcaaaaattgaaaaaaaaggagtacccaaagatagagactgtgaaggaagttgaagcctttacttttgctgatcatgaaatgggttccaatgaagttcatctgatagcaagacatgtcaccacatctgtggtcacatatttgaagaactttgaaactacagtttttagtgaggaaaagatgtctgtttctacatggtcaaggaaaaaatatgaatcaaaacagttcctaagaaacatatacgatgattcttcaatttatcaatgttgtgaacatctcactgagtcagtactttaccatttaacttcgagcatttctgatggcaccaaaaagggtagagaaaaagagaaagcatgggaaattcaagaagcaacatttagcaagattatttcaattcattctcaagtgtttgagagcaggtcaatttccattggagaacttgctttatgtatttctgaaatcattattaaaattctttttaataataaaattatacaggctgacattgcacagaaaatggttgccatacctacaaaatacacttactgtccaggaatagtttctggtggctttgatgacctctttcaggatctcttagtaggagtgattcatgtactgtccaaagaaatagaagtagattatcactttgaaagcaatgtaagaaacaaatcattttctatgcatagaaataatagtgtacccctttgcaacaaaatcaatagacaggcaagccccagagactggcaattttctactcaacaaattggtcaactttttcaaaaaaataagttaagttatcttgcatgtaagttaaacagcctggttggtaacctaaaaacaagtgaatccaaagaagtagtcaataaagtttttaatattgtttcagatttattttcaccagatgaatgcctagatacgggtatggattctggtaaaatacaaagaacatatttctactcctcgaataatgagcaacctaatagcatacttaccaataacctacagctctcctcaaaatcagtttttcttctcaatgttgtatgtgagaaacttatcagaatacttttggaagaatgcacaagcactgcttttcctgataaagggtctgtttcagaggaaacatcagcagaagaatgtcaacttttaaaaatgcttcaaagtgtagaagatggaaaatctgattatcgtaagggaggaatggactgtgaatgccttcaagtagattacatgtcagaccttttggagaatgtggcagaaattgatcaagacttattgacatcagactctatgcttactattatttcccacagcttggttaaatcattgatggacaaattatctcacagcatacaacaagctccggaaagtctaccttttgcaaataagcatttgaactacagaacaagagaaatacagtctagtttcataaaagcaagaaagtcagaattaatagaattaggacagagtaaaagttctttagaactcaggagctatgatagtaattctttgacagtatccctgaataatcccagtgtggttagctccaaaatacaagcaccatttaacaagcattgtgcagtaaaatcctcttctgtgtcaccttttgaaagacagagaacaaaggaaatggataaggtagccattcataataagctacatcaggaaggtatatatgctggtgtttattcagccacatttttggaaggaataatttcagaattgttttttaatctctctatgtcattgtggggcaaaaataaaaacatcactgtgtcctggctcaatgagatgaatacattatttgtcaacaatgtagtgaatgaatttaataatgctcaagtcactgttctacggaatgctgaagaaaggctgtgttttccaccagttcatacagaaactgttagcaaaattgttgactcagtttattatgatgttttacagcagtatgaattaaaagtggcctgtggtaataatccggtatacgacaatgcctcaatagcagaacaaataacaaatggcatattgttagagattttagactacaaactgccatcttgcttcaaggaacatctcataccccattcatattaccctctcaaacctgaaattatattgcaaaagcttcaaagtaacctaacagaatttacttctctacccaggtcttcatcagactatagtaccatgttatcacattcatttttagaagatgtcataagaaggcttttatctcagctaattcctccacccattacatgttcctctttaggaaaaaaatatttaatgagttctgattttaatgaaatgtccacttgtataataaataaggttatgtcagccatttcaaaacataaaatctggttcactatatatgataatcaatatctatatactggaaaaaacctccaaaagatggtggattctgtatattgtaatattttgcaaatgtctgactctcttgtttcaatacaaaaaagtatagtaagccgaagcccaattatgattgaccaaatagccagctttatcatccaagagattatcgaaaatcatcttcaaccatttttgagtggagaggttttatgtcatccaaggactccactggatccagtgtctactattgttacacaggttctgagtgaagtgatagagtcacacagacctcagaagcaatcacctttagatattcaccttgattcatttgtaagggagattgttgccagacttttgtcaaagattttcagcccaaagcataacactgaaattgagttgaaaaacatgacccaaagaatagtaaactccataaataggcatttcaataaagctaaaattcacattctctatgatgacaaagaacaggctttcttttctttcaatacagatattgtggatgaacttgccacctcagtttatagaaatgctttaaagcagcatgggctagaccttgctgttgataaagagtctgaagacagtggcatttttgtggaaaatattaccaatttaattgtagcagctatttcagattaccttcttcatccactgttttctggggatttttcagcttctacctattctaattcagtggctgagaatattgttcaggacatccttagtaacatcagtaaatctactgagccaagccagagtgtacctctatataacaccttgctgccatacacatttttagaagatatgatcagagtactattatctaaattattttcttctgcatctagcctggttctaaacagagacacccaaaaagatatatcaagagtgaatttcaatgacattgcttcaaacctagttagtgatattaggatgaaagtttcccaacatgaaattcgattttcaaaagaggaagaagaaaccaagtttatttattcagaagatgatattcagcaccttgttgattcagtatttgcaaatgttgtgcaaacctctggttctcaagaatcagctgtgcaaaatatcacaagcagtaatgacattcttatagatagaatagcaggtttcatcattaaacatatctgtcaaaaacatcttcagccatttgtgagtggaaaatcattatcttcatcagacacatattttgatgatgagagaaggcagttattttataccagtgtttactcttcaacattcttggaagatgtaatctctggggttttaagaaaaatattccacagggtagtaggcattgtacaaacaaaatccataagagattcagaagatgaactgtttgagaaagctgaagaactcatacatttgattacaggggaattctcaaaagcccaagttagcattatagataatactgaggaaagactgtgtttacctccagtggagagggatgtagtcaaaacaattgttgacatggtgtacagcaaagttttgcaagaatatgaaatggaagtcgtgcccaataaagattttctaaatgacacaaagacattggctgcaagaataactaatatcatcctggctgaaatttttgatttccaaattcatccagatcttatagcaaatctgccttttaaatcacattccaaactcagtgcaaatgttttaatacaaagagttcaatatgatataagtaaatcaagattccaaagacaagcttcaacaatgtataccactatgttatcacatagtcatttggaaaaaatagttactcagcttacatctcagataagtccattgaacaccagtgcagagcagtcagatactactaaatcagacttaagtaatacagtgataaaactgataaatgaaattatgtcaataatttcaaaacatgaaatatgtattattaaatatgggaataaaaaacagagtatgatttcagcaaaagatatccagtctatggttgattccatttatgctgatctttctcattcaaatatataccagtccattacaaaagataaaaagagcataagtgacatacctgtttcaaaaatagcgagttttataataaaagaaatctttaaccatcatattcaatcatttttatctgaagataaaactctccttttggcagcagttgatcaaacttataaattgaaagcaatagatcctaaacaaagagaattatcttttattgtgaactcatctgtctttttggaggaagtaatttctgagctcttatgcaaaattctttatgcattttcacataacatgttggttactgaaaatccagatagagtgaaactgaaacttaccaggattgttacaacattggtaaattcaattgttctggagttcaccacatcagagattttagttgcagataactttgataaaaatttgtgtttctcagaaagatacaaagaaatggttcaaaaaatagtcaactcagtatatggaaaagtattagatcaatataaatctctgattcaaatacatagggttatacaaagtgacacaatatgttttggtaggaaaatatattatttgctattggaagaaatatatgattatcaagtgcagtcattagtttcaggagaattagagtcttcttcttattcgtatccccaagctgataatatcatcagaaatgtgcttaacataatcacaaaggatagccatgccttgccaccatatattactgtgttgcctcattctcttttagaagatatggtttacaggcttctagggcatgtcttcccttcaactcacactgaaaatgaactaaaagagaaaaagtttccaccggatgatgaatttgtggaggcagcttcaaaattgactgatgaaattataaaagaaatttctgaacatgagattcgactttccatggcagaggataatgcagaaagtatgcagttagaacctattgaaaatttggtcgactccatatgtaataatattttgaaaacatctgaattccaagctgaagtacaaaaagatgcagacaaaaaaggatgctcattcctcagtaaattagctggttttattatgaaagaaatcatgtatcatcatttacagccatttttacatggtgaagaatcatctttcagtgacttatctgattatgaccatgtctctgaacttgctaaatctggtaaagaaaagacacagccttctctctattcagctacatttttggaagacataatcattgaccttgttcacaaattttgttctctcctcattattactgaagattctaagaaaaatgaaatggcagagctagatattatgggcttggctctaaaacttgcaaattctctgataagggaatttaagaaaagtgatattaaagttttaccaaatgctgaaaaaatgttttcttttccaccaattgataaagagacagttgataaaatatccaattttgtatatgaacagttcatagaaaaatgcacatctcatgatattcaaaaaggtgatgaaagtaacattgctatagggatgattgctgctctaacccagaaggcaatatctgcattcaggattcaaccacttttttcaggagactggtcttccaccttcttttcatttctaaatccagataatatcacccaaagggttcaacacctaccacaaaacacctttacacaaataagcagatgtgcaaaagagaaccaactttctttaccagatcaatcatataaagatacttcttccaccccagattgcaaaaacatgatgagcactttggaaataaatagaggtacaatgaatagaaagaaaagttttaaaaccaaggacacatcagtgaaaaaaggtgacatccaaaatccagtacttagctctataaatgcaattatgaaaagcggcatgattaacctaacatcagggttggctacaggtgtgacaaataaaaaggaagtggatgaaaataaagtgggaatttgtactcaaaaacatagtgagaatgtatcaaaagttacttcaactaccactgtgaaaagtaaagatactcaggagccaaatttgagtgaaacatttaataataatgaaattgagaagaaaagaaatttaattccaacagataaaaaagggaaagatgatgagatatacacacatttttcattaataattgatgatacagaatatgagaaggaagtacttggatcagattctgaaataggctataaaaagaagattgacaatgcaagggaaagctcatttaaaaaagatgacaagctctttcagttatcctccttgaagtccaagagaaatctagggactacaacagatactttggaaataagaattcgaacatcaagcaatgaggggagaagagactctccaacacaaacgtgtagggatgaggaacaccactcagattatgaacatgttcaaaatgtcattgaaaatatttttgaagatgttttagaactatcttcttctccagaaccagcatattattcgaaactcagttatgaccaaagccccccaggtgataatgtattaaatgtaattcaagagattagcagggattcggcacagtctgttacaacaaaaaaagtatcctcctcaactaacaaaaatatctctgccaaagaaaaagaagaggaagagagagaaaaagagaaagtaagagaggagattaaaagtgaacccagtaaaccagatgatcctcaaaaccaacgagaaagtaaacctggaatttttcccgctaagtttttagaagatgttattactgagatggttaaacaattgatcttttcttctataccagaaacacaaatacaagatagatgtcaaaatgttagtgataagcaaaatcaagccaaactctatgacactgctatgaaactcatcaattcactgttaaaggagttctcagatgctcaaattaaggttttcaggccagataagggaaatcagttccctgggggtaaagtgtcttcagttcctaaagtacctccaaggtataaagagccaactacagatgaagcaccatccagcattaagataaaatctgcagataaaatgccacctatgcataaaatgatgagaaaaccttcttcagataagataccatcaattgacaaaacattggtcaataaagttgttcactcctctgtttgtaatattttaaatgactatggatctcaagactctatttggaagaatataaacagtaatggagaaaatttagcaagaagactaactagtgcagtgataaatgaaattttccaacgtcaggttaacttgatattttgtgatgaggtttcagtttcagcatgtttgcctctggaatctaaggatgttgttaaaaaggtccaaaagttggcccaaacagccagcaaagaatgtcaaacttcatcaccatatacaataatattacctcataaatttttggagaatgtgatttctgctcttttctccaaaattttctcaacaatatccagcacaaaaacaaaagaacctgaggacaatttgtccacagaactgaatttccttcaaatgaagttagtaagtgcagttgcaacagagatctcccaagataaatatatgactatacagtatgtagaaaccttacaatctgatgatgatgaaattattcaattagtggttcagtctgtttataataatctcttgccacagtttggatcacaagagattatacaaaattgtgtaaccagtggatgcaaaatcctttcagaaaacatagttgacttggttctacgagaagtggctagcaatcagctgcagagctatttttgtggagagctaactccacatcagtgtgtggaagttgaaaacatcgttgaaaagatccttaaagatgttttccaaactactgatgtgcccctacctaaaccttcacatgctgataagctgtcttataacataatagaagaaattgctgtgaaatttttatcaaagcttttatctatatttccaaaagtacataaagaaagaacaaaatctctagagactgatatgcaaaaaataacttcaaaagtactaaattcagtccaagaatttatctccaaaagtaagattaaacttgtaccacccaccaaggaatcacctactgtgcctgtagctgataatgcaactattgaaaacatagttaattctatttataccagtgttttaaagcactctggctcttatacttctgtatttaaagatttaatgggtaaaagcaatgtcctctctgatacaataggctttttaatggtgaatgcaatttcgaattctgaatttcaacctcaagtagaggaagaagtatcaaattcagaattagttctggaagctgtcaaaattatggaaaaagtgatcaaaattattgatgaacttaagtctaaggaaaagtcttcatccagaaaaggtttgacattagatgccaaacttttagaagaggtgttggccttgttcttggctaaactaataaggttgccaagttcctcaagcaaagatgaaaaaaacttatcaaagactgagttaaataaaattgcatctcaactgtcaaaattggtaacagctgaaatttccagaagtagcattagtctaatagcttctgatcctgaagagcactgtttaaatccagaaaatacagaaaggatttatcaggttgtcgattccgtttatagtaacatactgcaacaatcaggaaccaacaaagaattttattatgatataaaagatacaaatacagcctttcctaaaaaagtggctagtttaattattgatggagtttcaagttttccattagatacaattaactcaacaatttcaaatgctgatctctctggagagctagacgttaatagaattgttcaaaaggcccaagaacatgcttttaatgtgattcctgaattagagcaagaaaagttagatcaaaatttatctgaagaggaatctccaattaaaatagttccacatgttggaaaaaaaccagtcaaaatagatccaaaaattatttcagaacacttagcagttatttctataaaaactcaacctcttgagaaacttaagcaggagtgtttgaaaagaactggacatagcatagcagaactgagaagagcatcaataagtgggagaaattactccttaggatcacctgatttagaaaagagaaagacagaaagacgtacctcattggataagactggaagactggatgtaaaacccctagaggccgttgctagaaattcatttcagaatataagaaagcctgatattacaaaggtggagctcttaaaagatgttcaaagtaaaaatgatcttattgttcgattagtagctcatgatattgatcaagtgtatttggaaaattacataaaagaggaacgagattctgatgaagatgaagttgttttaacacagacttttgcaaaagaagaaggcatcaaagtatttgaagatcaagtgaaagaagtcaagaagccaatacaaagcaaactttctcctaagtcaacactaagcacgagcagcctgaaaaaatttttgtcactaagtaaatgttgtcagaccacagccagtgcaaatattgaaagtactgaagcaatctcaaatcaggtaatagaatccaaggagacacatgttaaaagagctgttgctgagcttgacatggccacaccaaagacgatgcctgaaacagcctcttcatcttgggaggaaaagccccagtgtaagaaagaagaaaagaatcttgttactgaaccaacacattacttcatacacagaattatgagttcatcttcatacaaccaagaagatctcatttcatctactggtgaggctgaagattgtcactcagacccaagtgctaaaatattagaagaaagttctcaggaacaaaagccagagcatggaaacagtgttaagtttatcaccatctttgaaagatccaaggatgttcttggcagtgcaaatccctcaaaggaagtcatttcagaaactcccaagcccgatgtctccaaacaaggatctaaaatgctgacaaaaatgtcttcaactttgtcaaaggtgttttctcaatgtaacaccaatatttccagatcttcctcaccagctcaccaggatgaacactgaagcttttgtacctgatataagtatgcttacttcttttagaaaataaaatggtttttaaagcata

SEQ ID NO: 2405 - DNA, 2726 bp, Homo sapiens
aaggaccaggagcggctgatgaggcatagatatttggatatgataagtagaaaactagaacaacttgaacgcacagcagaagaacaacgcctattcctaatggatagagaagaaagacgacagcgggaacacacaagaagaaaacttactcttcgtagaaaaatagaagaggaatggaagacaaaagagatgttacttctgacaaggatggcagaagatgttaaaagagaagagaggatagaagaacaacagcatagaaacagagaagagagtgacaggaagaaacaagatcttctagagaaaaaaatggcttatcatttacaaaaaatgcaagatactggctttaacggagaagatataggaaaaaatacatttaaatacagaggtcaagatggaacacatggtgaatgacatacagcaaatgctgctcatcagcgtcaaaatagttcaaataattttacgaaaaaaaactcagcttctgttgtttatcaggcagatgtacaggataatggtataaatcaaaagagagatgggatggtatctaaaaactcaagtattttcgatgatagaggaggtataaatatttcaggccaaggttcaattatttcagcgcaggtatcacccacgagaaatttttccagagtttcacaggcatttttggatccttcaaaagaagagaaggagacaaatgctgattgggatggaagaccaaccaagagatcaagctatctctgcgaatcaggtaaatatcagcagtaattattgagtaaatcttgcattctatttattctttcaactgacatttactgagtttttgcttcatgttagatatggtgctaagttttaatcattcaaggaaaaatggcacaatttttgctcagggttcttacagtatacttggaaagatagtcatggcccaatatgataagagcaataaaggaagtgggtatgtgtaaaagctgggaaagttatgggaaagagaatgcatagacctatctagggtcatcatagaagcctttataatttagaaagagactgcgttgagacatgaaggatcagaaggaatttcctattttctttttgttatttttattgtttgtactaatgttgacaaccaaaatttgcaaaaaaattaaagtttttgtactcatatccttatacttactgttttctgcttttacagcagcttctctcccacaccacaactttattaaggtatagtggataatttaaaactgtatatattgacggtacagatggtccccaacttgtaatgattcaatttagggtttttcaactttactgtcggtttattggggtattaaatgcattctcagcttacaatatttttgacttacaattggctaatcaagatgtaacaccatcataagacaaggagaatcatatacaacttgatatgtgtatatacagtaaagtgttcaccacaagcaagccaattaacatatcctcacttcatgtagttactatttgtgtgtggtggcagaagaacacttaagagctactctctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctttgttttggtaccagtaccatgctgttttggttactgtagccttgtagtatagtttgaagtcaggtagtgtgatgcctccagctttgttcttttggcttaggattgaattggtgatgcgggctcttttttggttccatatgaactttaaagtagttttttccaattctgtgaagaaagtcatcggtagcttgatggggatggcattgaatctataaattaccttgggcagtatggccattttcacgatattgattcttcctacccatgagcatggaatgttcttctatttgtttgtatcctcttttatttccttgagcagcggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacagtcatgtcgtctgcaaacagggacaatttgacttcctcttttcctaattgaataacctggatcccttccttacaccttatacaaaaatcaattcaagatggattaaagacttaaacgttagacctaaaaccataaaaaccctagaagaaaacctaggcattaccattcgggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaataaccagaatctacaatgaactcaaacaaatttacaagaaaaaaacaaacaaccccatcaaaaagtgggtgaaggacatgaacagacacttctcaaaagaagacatttatgcagcc

SEQ ID NO: 2406 - DNA, 2726 bp, Homo sapiens; identical to SEQ ID NO: 2405

SEQ ID NO: 2407 - DNA, 3347 bp, Homo sapiens
aaatgcgagggaaggacaagtggggaaagccaatccgccgcgacgagggctgcgggcggttcaatggcaagtcgccgggggcggggccagaggccggcggagaaggaggacccgggagccggcggcccggagctgggagcgcggggaaggcggttggggttctgacagctgcgcgcgatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccagcgggtaagttggaagccagagctgccctgaaccaggccctggagatgaagcgccagggcaagcgggaaaaagcccaaaagctcttcatgcacgccctcaagatggacccggacttcgtggacgcgctcaccgagtttggcatcttctcggaagaagacaaggacatcatccaggcggactacttgtacaccagagcattgaccatctcaccctaccatgagaaagcactggtcaaccgcgatcggacactgcctcttgtggaagagatcgaccagaggtatttcagcatcatcgacagcaaagtgaagaaggtcatgtccatccccaaggggaactcagctctgcgcagggtcatggaggagacctactaccatcacatctaccacacagtggccatcgagggcaacaccctcaccctctcggaaatcaggcacatcctggagacccgctacgccgtgcccgggaagagcctggaggagcagaacgaggtcataggcatgcatgcagccatgaagtacatcaacacgactctggtttcgcgcatcggctccgtcaccatcagcgacgtgctggagatccacaggcgggtgctgggctacgtggaccccgtggaagccggcaggtttcggacaacacaggtcctggtcggacaccacatccctccccatccgcaggatgtggaaaagcagatgcaggagtttgtacagtggctcaactccgaggaagccatgaacctgcacccagtggagtttgcagccttagcccattataaactcgtttacatccaccctttcattgatggcaacgggaggacctcccgtctgctcatgaacctcatcctcatgcaggcgggctacccgcccatcaccatccgcaaggagcagcggtccgactactaccacgtgttggaagctgccaacgagggcgacgtgaggcctttcattcgcttcatcgccaagtgtactgagaccaccctggacaccctgctttttgccacaactgagtactcggtggcactgccagaagcccaacccaaccactctgggttcaaggagacgcttcctgtgaagccctaaccctagaaatcctcagtgacaaaggctgtcctgaggtaggaaaaaaaaaaagaaacagcatttctagaaacctagtcacttcctaaagcaaaaggagaaacattctttacctccaaatgttttagttttaaaaaaaaaaaaaaactaagttatgaagccttgtctctaaaataacttataattcaaccaagctatttattttcttctttggagcaagctagtcagtattgtatggtgtctgctgtgtcttgctggtggccgtgctttaggggcaacagtgccaccatgtgaccagaacaaaggttctggagcagaatttgcactaaggtggaggagcggccaagaggtgtgggacggggcccagagccactgacataactcctccaagtgcttctctgaaacaggctgagaggttctgtgactgcaactgggaagtcagacccaagtcgcagctgagagaaatggttgaaagctcactttctcaaggtttagattagtggtgactaacttccaagcaaacttcatagaagagaaaatgaatgccgacattccttacttacctgcaggaagactttttgagccatagtttgcaaactttagtgccagcagctgtttttttttttttttttttcatattgagactatttttctaattaagaatagggggtagccataaagagctgtatgttggagggggaaacatggtgggcgggcagtttggttttctttgtgtatccgcgtttctctcacacttcatttgtagcaactcaggccagatgttttcgtctgaaattctctgggcttgtcattccacctgtatcgtgctgcaaaccaggtgttatgctagtaggcatctgccctcacccctctgcctgagttttctgtaggcagatgttaacctgagaaaacaagtgccatgtggacaccaagtaagcatttttgataatgaattagagcaccagtttctactgaatggagcaaaaaccttcagccatggccaggctgcatccctttggtcctggagtttcatctacttactgccatcttccacggtctttgcactgtcccgtgtcccatccccctgggaggcagaagagattgcctcggagtggccttatttttctcgcaacttgtgaaatgatgtagtgctctatgtaatatggccgggtttccaagctgtcatccaatggaagtagaatcttctctttgaatcatatggtacaggtgccaatatgactgctgctatttagagtcagagaggtggaagtcactgggtccctttcccagtgacagagcccatgatgtctaacactactgcactttgtcagtgtgtgagtgatggcgaatacgcagtgttgtctctttgatttggtaattccgttcctgacagtaatgaggccactgctctaaagtagtttatacagttcttcagttgtataaatagcacagagtagtttttgaaaggttaagaaaaataagtgaaaagacatacacgatatatgaaatggctccaaatgataattgttcaaacctttataaaatgtgttttcgtactcttatgctgccagaggtacttcttaaaactcttctcgtcttggttttataagcacaccacggaggtctgacagatgtgcttgcttctactacagagcaagagaatttgcactttagctatatgtgaaggatattattttaacaaattcctgattctaataaagttattttattacatgaa

SEQ ID NO: 2408 - DNA, 1530 bp, Homo sapiens
tctgtccctagccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggagacatctgtgccttctgccacaagaccgtgtccccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagaggtgcggcaagtgtggcgaggtggtccgggaccacatcatcagggccctgggccaggccttccacccctcctgcttcacgtgtgtgacctgcgcccggtgcattggggatgagagctttgccctgggcagccagaacgaggtgtactgcctggacgacttctacaggaaattcgcccccgtctgcagcatctgtgaaaatcccatcatccctcgggatgggaaagatgccttcaaaatcgaatgcatgggaagaaacttccatgaaaattgctacaggtgtgaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccagcctgtccaggatacagtggggctgagcacccccaggccttccactcctctaccctctgggcaccagaaggctcctggaccatgagcttcacccccagaattccctgctgaccctgccccacttccagggaaaagctgggggaggttggacccctctcactgactagctgtctggtaggggtgctaggaccagcctcgcctgtggggttgagctgtttgaggacaaactccaaggtcccttaaaaagtgccttttagaggctgggcatggtggctcacgcttgtaatcccagcactttgggaggccaaggtgggtggatcacctgaggtcaggagttcaagaccagcctggccaacatggtgaaaccctgtctctactaaaaatacaaaaattagccaggcatggtagcaggtgcctgtaatcccagctactggggaaagctgaggcaggagaattgcttcaatctggaaggcagaggttgcagtgagattgcaccattgcattccagcctgggcaacaagagggaaactccgtct

SEQ ID NO: 2409 - DNA, 3695 bp, Homo sapiens
atgaagaacgcgaggggatgggcagcggggagggaaggaaacccaccccgactccccattctcctacccccactccccatccctcccattcccccatcgcccccatccccattcccccccattcccaccccctggcctgtgccaagggggaggggaggcgtcgtccagggaacaaagggagggggaaggggcggcgcggggcgcggccgggcaggttggggggcaggtaggggccgcttccgcggggcgggaatcccgcgccccctccccccgagcctcaccttttatggtaaagcggcgcggggcggcggggcggagggagccgagggggcggggagggcggacgggcggaggggacgggaggcccagcggctccgggctccgctggctcgggcgtcggatcggagccgccggggcgcgggcggcccagagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggaggatgcccaccccctcctcctgtcctggatggtgaggacgtgcttcctgacctggacctcctcccaccccctccaccgccccctccagtgcttctgccttctgaagaggaggctcctgctccaatgggggcctcactcattgcagacttagagcagctgcacctgtccccgcccccgcccccaccacaggccccagcggagggaccttcagtccagcccggtcccctcaggcccatggaggaagagctgccacctcccccggcagaacctgttgagaaaggggcatccacagacatctgtgccttctgccacaagaccgtgtccccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagaggtgcggcaagtgtggcgaggtggtccgggaccacatcatcagggccctgggccaggccttccacccctcctgcttcacgtgtgtgacctgcgcccggtgcattggggatgagagctttgccctgggcagccagaacgaggtgtactgcctggacgacttctacaggaaattcgcccccgtctgcagcatctgtgaaaatcccatcatccctcgggatgggaaagatgccttcaaaatcgaatgcatgggaagaaacttccatgaaaattgctacaggtgtgaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccagcctgtccaggatacagtggggctgagcacccccaggccttccactcctctaccctctgggcaccagaaggctcctggaccatgagcttcacccccagaattccctgctgaccctgccccacttccagggaaaagctgggggaggttggacccctctcactgactagctgtctggtaggggtgctaggaccagcctcgcctgtggggttgagctgtttgaggacaaactccaaggtcccttaaaaagtgccttttagaggctgggcatggtggctcacgcttgtaatcccagcactttgggaggccaaggtgggtggatcacctgaggtcaggagttcaagaccagcctggccaacatggtgaaaccctgtctctactaaaaatacaaaaattagccaggcatggtagcaggtgcctgtaatcccagctactggggaaagctgaggcaggagaattgcttcaatctggaaggcagaggttgcagtgagattgcaccattgcattccagcctgggcaacaagagggaaactccgtctcaaaaaaaaaaaagtgccttttaggccggatgtggtggctcatgcctgtaatcccagcactttgggaggccaaggcaggcagatcacttgaggtcaggagtttgagaccagcctggccaacacggcaaaaccccgtttctactaaaaatacaaaaattagctgggtgtggtggcgtgcgcctgtaatcccagctactcaggaggctgaggcaggagcattgcttgaacccgggaggcagaggttgcagtgagctgagatggcaccactgcactccagcctgggagacacagcgagactctgtctccaaaaaaaaaagtgctttttgaaaatgttgaggttgaaatgatgggaaccaacattctttggatttagtggggagcataatagcaaacacccccttggttcgcacatgtacaggaatgggacccagttggggcacagccatggacttccccgccctggaatgtgtggtgcaaagtggggccagggcccagacccaagaggagagggtggtccgcagacaccccgggatgtcagcatcccccgacctgccttctggcggcacctcccgggtgctgtgttgagtcagcaggcatggggtgagagcctggtatatgctgggaacagggtgcaggggccaagcgttcctccttcagccttgacttgggccatgcaccccctctcccccaaacacaaacaagcacttctccagtatggtgccaggacaggtgtcccttcagtcctctggttatgacctcaagtcctacttgggccctgcagcccagcctgtgttgtaacctctgcgtcctcaagaccacacctggaagattcttcttccctttgaaggagaatcatcattgttgctttatcacttctaagacattttgtacggcacggacaagttaaacagaatgtgcttccctccctggggtctcacacgctcccacgagaatgccacaggggccgtgcactgggcaggcttctctgtagaaccccaggggcttcggcccagaccacagcgtcttgccctgagcctagagcagggagtcccgaacttctgcattcacagaccacctccacaattgttataaccaaaggcctcctgttctgttatttcacttaaatcaacatgctattttgttttcactcacttctgactttagcctcgtgctgagccgtgtatccatgcagtcatgttcacgtgctagttacgtttttcttcttacacatgaaaataaatgcataagtgttagaagctcttcca

SEQ ID NO: 2410 - DNA, 3498 bp, Homo sapiens
gcgggccaggacgaatccctccatccgggagcagtggtggcggtggaacaggtggcctggggtgctggaggcaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaacagagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggaggatgcccaccccctcctcctgtcctggatggtgaggacgtgcttcctgacctggacctcctcccaccccctccaccgccccctccagtgcttctgccttctgaagaggaggctcctgctccaatgggggcctcactcattgcagacttagagcagctgcacctgtccccgcccccgcccccaccacaggccccagcggagggaccttcagtccagcccggtcccctcaggcccatggaggaagagctgccacctcccccggcagaacctgttgagaaaggggcatccacagacatctgtgccttctgccacaagaccgtgtccccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagaggtgcggcaagtgtggcgaggtggtccgggaccacatcatcagggccctgggccaggccttccacccctcctgcttcacgtgtgtgacctgcgcccggtgcattggggatgagagctttgccctgggcagccagaacgaggtgtactgcctggacgacttctacaggaaattcgcccccgtctgcagcatctgtgaaaatcccatcatccctcgggatgggaaagatgccttcaaaatcgaatgcatgggaagaaacttccatgaaaattgctacaggtgtgaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccagcctgtccaggatacagtggggctgagcacccccaggccttccactcctctaccctctgggcaccagaaggctcctggaccatgagcttcacccccagaattccctgctgaccctgccccacttccagggaaaagctgggggaggttggacccctctcactgactagctgtctggtaggggtgctaggaccagcctcgcctgtggggttgagctgtttgaggacaaactccaaggtcccttaaaaagtgccttttagaggctgggcatggtggctcacgcttgtaatcccagcactttgggaggccaaggtgggtggatcacctgaggtcaggagttcaagaccagcctggccaacatggtgaaaccctgtctctactaaaaatacaaaaattagccaggcatggtagcaggtgcctgtaatcccagctactggggaaagctgaggcaggagaattgcttcaatctggaaggcagaggttgcagtgagattgcaccattgcattccagcctgggcaacaagagggaaactccgtctcaaaaaaaaaaaagtgccttttaggccggatgtggtggctcatgcctgtaatcccagcactttgggaggccaaggcaggcagatcacttgaggtcaggagtttgagaccagcctggccaacacggcaaaaccccgtttctactaaaaatacaaaaattagctgggtgtggtggcgtgcgcctgtaatcccagctactcaggaggctgaggcaggagcattgcttgaacccgggaggcagaggttgcagtgagctgagatggcaccactgcactccagcctgggagacacagcgagactctgtctccaaaaaaaaaagtgctttttgaaaatgttgaggttgaaatgatgggaaccaacattctttggatttagtggggagcataatagcaaacacccccttggttcgcacatgtacaggaatgggacccagttggggcacagccatggacttccccgccctggaatgtgtggtgcaaagtggggccagggcccagacccaagaggagagggtggtccgcagacaccccgggatgtcagcatcccccgacctgccttctggcggcacctcccgggtgctgtgttgagtcagcaggcatggggtgagagcctggtatatgctgggaacagggtgcaggggccaagcgttcctccttcagccttgacttgggccatgcaccccctctcccccaaacacaaacaagcacttctccagtatggtgccaggacaggtgtcccttcagtcctctggttatgacctcaagtcctacttgggccctgcagcccagcctgtgttgtaacctctgcgtcctcaagaccacacctggaagattcttcttccctttgaaggagaatcatcattgttgctttatcacttctaagacattttgtacggcacggacaagttaaacagaatgtgcttccctccctggggtctcacacgctcccacgagaatgccacaggggccgtgcactgggcaggcttctctgtagaaccccaggggcttcggcccagaccacagcgtcttgccctgagcctagagcagggagtcccgaacttctgcattcacagaccacctccacaattgttataaccaaaggcctcctgttctgttatttcacttaaatcaacatgctattttgttttcactcacttctgactttagcctcgtgctgagccgtgtatccatgcagtcatgttcacgtgctagttacgtttttcttcttacacatgaaaataaatgcataagtgttagaagctcttcca

SEQ ID NO: 2411 - DNA, 3058 bp, Homo sapiens
ggacgggcggaggggacgggaggcccagcggctccgggctccgctggctcgggcgtcggatcggagccgccggggcgcgggcggcccagagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggagacatctgtgccttctgccacaagaccgtgtccccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagaggtgcggcaagtgtggcgaggtggtccgggaccacatcatcagggccctgggccaggccttccacccctcctgcttcacgtgtgtgacctgcgcccggtgcattggggatgagagctttgccctgggcagccagaacgaggtgtactgcctggacgacttctacaggaaattcgcccccgtctgcagcatctgtgaaaatcccatcatccctcgggatgggaaagatgccttcaaaatcgaatgcatgggaagaaacttccatgaaaattgctacaggtgtgaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccagcctgtccaggatacagtggggctgagcacccccaggccttccactcctctaccctctgggcaccagaaggctcctggaccatgagcttcacccccagaattccctgctgaccctgccccacttccagggaaaagctgggggaggttggacccctctcactgactagctgtctggtaggggtgctaggaccagcctcgcctgtggggttgagctgtttgaggacaaactccaaggtcccttaaaaagtgccttttagaggctgggcatggtggctcacgcttgtaatcccagcactttgggaggccaaggtgggtggatcacctgaggtcaggagttcaagaccagcctggccaacatggtgaaaccctgtctctactaaaaatacaaaaattagccaggcatggtagcaggtgcctgtaatcccagctactggggaaagctgaggcaggagaattgcttcaatctggaaggcagaggttgcagtgagattgcaccattgcattccagcctgggcaacaagagggaaactccgtctcaaaaaaaaaaaagtgccttttaggccggatgtggtggctcatgcctgtaatcccagcactttgggaggccaaggcaggcagatcacttgaggtcaggagtttgagaccagcctggccaacacggcaaaaccccgtttctactaaaaatacaaaaattagctgggtgtggtggcgtgcgcctgtaatcccagctactcaggaggctgaggcaggagcattgcttgaacccgggaggcagaggttgcagtgagctgagatggcaccactgcactccagcctgggagacacagcgagactctgtctccaaaaaaaaaagtgctttttgaaaatgttgaggttgaaatgatgggaaccaacattctttggatttagtggggagcataatagcaaacacccccttggttcgcacatgtacaggaatgggacccagttggggcacagccatggacttccccgccctggaatgtgtggtgcaaagtggggccagggcccagacccaagaggagagggtggtccgcagacaccccgggatgtcagcatcccccgacctgccttctggcggcacctcccgggtgctgtgttgagtcagcaggcatggggtgagagcctggtatatgctgggaacagggtgcaggggccaagcgttcctccttcagccttgacttgggccatgcaccccctctcccccaaacacaaacaagcacttctccagtatggtgccaggacaggtgtcccttcagtcctctggttatgacctcaagtcctacttgggccctgcagcccagcctgtgttgtaacctctgcgtcctcaagaccacacctggaagattcttcttccctttgaaggagaatcatcattgttgctttatcacttctaagacattttgtacggcacggacaagttaaacagaatgtgcttccctccctggggtctcacacgctcccacgagaatgccacaggggccgtgcactgggcaggcttctctgtagaaccccaggggcttcggcccagaccacagcgtcttgccctgagcctagagcagggagtcccgaacttctgcattcacagaccacctccacaattgttataaccaaaggcctcctgttctgttatttcacttaaatcaacatgctattttgttttcactcacttctgactttagcctcgtgctgagccgtgtatccatgcagtcatgttcacgtgctagttacgtttttcttcttacacatgaaaataaatgcataagtgttagaagctc

SEQ ID NO: 2412 - DNA, 507 bp, Homo sapiens
gacacccgagctgctgcgggccaggacgaatccctccatccgggagcagtggtggcggtggaacaggtggcctggggtgctggaggcaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaaagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctgg

SEQ ID NO: 2413 - DNA, 577 bp, Homo sapiens
gctccgctggctcgggcgtcggatcggagccgccggggcgcgggcggcccagcagagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggaggatgcccaccccctcctcctgtcctggatggtgaggacgtgcttcctgacctggacctcctc

SEQ ID NO: 2414 - DNA, 1543 bp, Homo sapiens
tggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggaggatgcccaccccctcctcctgtcctggatggtgaggacgtgcttcctgacctggacctcctcccaccccctccaccgccccctccagtgcttctgccttctgaagaggaggctcctgctccaatgggggcctcactcattgcagacttagagcagctgcacctgtccccgcccccgcccccaccacaggccccagcggagggaccttcagtccagcccggtcccctcaggcccatggaggaagagctgccacctcccccggcagaacctgttgagaaaggggcatccacagacatctgtgccttctgccacaagaccgtgtccccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagaggtgcggcaagtgtggcgaggtggtccgggaccacatcatcagggccctgggccaggccttccacccctcctgcttcacgtgtgtgacctgcgcccggtgcattggggatgagagctttgccctgggcagccagaacgaggtgtactgcctggacgacttctacaggtacgagaagggtttgtgcactgggtggggtgcagggacagggcgagacccaagcagggtgaaggagctgagcttgagtcctgggtgctgggccagagtttcctgtctactggtttattataaagaatattacagggctgggctgggcgcggtggctcacgcctgtaatcccagcactttgggaggccgaggcgggtggatcacgaggtcaggagatcgagatcatcctggctaacatggtgaaaccccgtctctactaaaaatacaaaaaaaattagccaggcatggtggcgggcgcctgtagtcccagctactcgggaggctgaggcaggagaatggcgtgaacctgggaggcagagcttgcagtgagccgagatcacgccactgcactccagcctgggcaacagagtgtgagactccgtctcaaaaaaaaaaaaaaaaaaaaa

SEQ ID NO: 2415 - DNA, 571 bp, Homo sapiens
ccagcggctccgggctccgctggctcgggcgtcggatcggagccgccggggcgcgggcggcccagagctggcctgaacctccaggacttcagcccttctaggagaatctgatcccagccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggaggatgcccaccccctcctcctgtcctggatggtgaggacgtgcttcctgacctggacctcctcccaccccctccaccgccccctccagtgcttctgccttctgaagaggaggctcctgctccaatgggggcctcactcattgcagacttagagcagctgcacctgtccccgcccccgcccccacc

SEQ ID NO: 2416 - DNA, 611 bp, Homo sapiens
gttgcaggaagtttggcacctgccgatcggtgacatcgacacccgagctgctgcgggccaggacgaatccctccatccgggagcagtggtggcggtggaacaggtggcctggggtgctggaggcaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaagtaagcgctcacctccgccggacaggcagagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtg

SEQ ID NO: 2417 - DNA, 582 bp, Homo sapiens
agccgggccctgccttccagagctcctggagcggcctgtcccccgggacaccgggacccacctgcagagggcttaccgctcaggagagcagaacaaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaagtaagcgctcacctccgccggacaggagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgagg

SEQ ID NO: 2418 - DNA, 562 bp, Homo sapiens
ccgggctccgctggctcgggcgtcggatcggagccgccggggcgcgggcggcccagagctggcctgaacctccaggacttcagcccttctaggagaatctgatcccagccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggagacatctgtgccttctgccacaagaccgtgtccccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagag

SEQ ID NO: 2419 - DNA, 611 bp, Homo sapiens
gtttggcacctgccgatcggtgacatcgacacccgagctgctgcgggccaggacgaatccctccatccgggagcagtggtggcggtggaacaggtggcctggggtgctggaggcaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaagtaagcgctcacctccgccggacaggagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgaggcaggcagttt

SEQ ID NO: 2420 - DNA, 576 bp, Homo sapiens
atcgacacccgagctgctgcgggccaggacgaatccctccatccgggagcagtggtggcggtggaacaggtggcctggggtgctggaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaagtaagcgctcacctccgccggacaggagctggcctgaacctccaggacttcagcccttctaggagaatctgatcccagccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatg

SEQ ID NO: 2421 - DNA, 511 bp, Homo sapiens
cagccgggccctgccttccagagctcctggagcggcctgtcccccgggacaccgggacccacctgcagagggcttaccgctcaggagagcagaacaaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaacagagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttat

SEQ ID NO: 2422 - DNA, 630 bp, Homo sapiens
cgtggcaagcggttcgggagaagaaactcggggctctggggtcgtcgagcacgtggcgaggggagagacgttgctcttccgtgcctcttttccctccttgcttttctgccagttcctacctggcacggagaagtgcagggtggagagatctccgagaagcgccagccttctggggcttcctgttccttacagcgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaactta

SEQ ID NO: 2423 - DNA, 959 bp, Homo sapiens
agtctggcctgggcgccgcgggaacgctgtcctggctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagggactaaagacaacctgatgaggccacctggcatgacctccagcagccagtaacttgttagggaagagacctgcttgggccacatgggtctgctgcctgtgccaccacctttcccagaacactggacttctttcctgcccttttctacaactctacgctgtgtcagctgtacagccaccccccaccccttcctttcagcctccatcagggaagagacagtaaaaataatcacagtcaagtgattcaaaacaaaacaaaaagcaactgttaaagccaagtctgccccataactttaaaagccatcattggtcactgccgatgtctatttttgaagggttgagatggacagatttcccaagatgcatatcttttgctttcagttctaacaaatgttctattagctaaaatgtgttgtactccacagagtattgggctcgtaattctttttttttttttgagatggagtttcactcttgttg

SEQ ID NO: 2424 - DNA, 1030 bp, Homo sapiens
ggcacatcctgagcaccctgtgccttatctgtaaaatggaaacaatcatgccgacctttcagggtggttttgaggattagagactagctcctgacacacagtaggtaatcgtaaatgggtgctattgtttggcccgacccacgttataggacagaacgtctaacggatgcgtcagaacctgcgccctccggatcttggagggtacagagggcgcccctcggcctcctccctttcggaggtggggacaaggtggaggaagggctgcaggaggaggagctctagcatcgcgacccgccccgtcccgtccagtctggcctgggcgccgcgggaacgctgtcctggctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaactta

SEQ ID NO: 2425 - DNA, 4960 bp, Homo sapiens
aggttcgtgacccttgagaaaagagttggtggtaaatgtgccacgtcttctaagaagggggagtcctgaacttgtctgaagcccttgtccgtaagccttgaactacgttcttaaatctatgaagtcgagggacctttcgctgcttttgtagggacttctttccttgcttcagcaacatgaggcttttcttgtggaacgcggtcttgactctgttcgtcacttctttgattggggctttgatccctgaaccagaagtgaaaattgaagttctccagaagccattcatctgccatcgcaagaccaaaggaggggatttgatgttggtccactatgaaggctacttagaaaaggacggctccttatttcactccactcacaaacataacaatggtcagcccatttggtttaccctgggcatcctggaggctctcaaaggttgggaccagggcttgaaaggaatgtgtgtaggagagaagagaaagctcatcattcctcctgctctgggctatggaaaagaaggaaaaggtaaaattcccccagaaagtacactgatatttaatattgatctcctggagattcgaaatggaccaagatcccatgaatcattccaagaaatggatcttaatgatgactggaaactctctaaagatgaggttaaagcatatttaaagaaggagtttgaaaaacatggtgcggtggtgaatgaaagtcatcatgatgctttggtggaggatatttttgataaagaagatgaagacaaagatgggtttatatctgccagagaatttacatataaacacgatgagttatagagatacatctacccttttaatatagcactcatctttcaagagagggcagtcatctttaaagaacattttatttttatacaatgttctttcttgctttgttttttatttttatatattttttctgactcctatttaaagaaccccttaggtttctaagtacccatttctttctgataagttattgggaagaaaaagctaattggtctttgaatagaagacttctggacaatttttcactttcacagatatgaagctttgttttactttctcacttataaatttaaaatgttgcaactgggaatataccacgacatgagaccaggttatagcacaaattagcaccctatatttctgcttccctctattttctccaagttagaggtcaacatttgaaaagccttttgcaatagcccaaggcttgctattttcatgttataatgaaatagtttatgtgtaactggctctgagtctctgcttgaggaccagaggaaaatggttgttggacctgacttgttaatggctactgctttactaaggagatgtgcaatgctgaagttagaaacaaggttaatagccaggcatggtggctcatgcctgtaatcccagcactttgggaggctgaggcgggcggatcacctgaggttgggagttcgagaccagcctgaccaacacggagaaaccctatctctactaaaaatacaaaagtagccgggcgtggtgatgcgtgcctgtaatcccagctacccaggaaggctgaggcggcagaatcacttgaacccggaggcggaggttgcggtaagccgagatcacctccagcctggacactctgtctcgaaaaaaagaaaagaaacacggttaataacatataaatatgtatgcattgagacatgctacctaggacttaagctgatgaagcttggctcctagtgattggtggcctattatgataaataggacaaatcatttatgtgtgagtttctttgtaataaaatgtatcaatatgttatagatgaggtagaaagttatatttatattcaatatttacttcttaaggctagcggaatatccttcctggttctttaatgggtagtctatagtatattatactacaataacattgtatcataagataaagtagtaaaccagtctacattttcccatttctgtctcatcaaaaactgaagttagctgggtgtggtggctcatgcctgtaatcccagcactttgggggccaaggagggtggatcacttgagatcaggagttcaagaccagcctggccaacatggtgaaaccttgtctctactaaaaatacaaaaattagccaggcgtggtggtgcacacctgtagtcccagctactcgggaggctgagacaggagatttgcttgaacccgggaggcggaggttgcagtgagccaagattgtgccactgcactccagcctgggtgacagagcaagactccatctcaaaaaaaaaaaaagaagcagacctacagcagctactattgaataaatacctatcctggattttaaaaaagaaaaaaatatatataattttattttaaattggcttttatctttaattcttttttttaaagttatcaaatcttcattttctaagagtagccctttatagtgtacaaaatgatattaagtgcattattatcttcgcttttcatggctctgagtcataaaacaagctggtggatctcactgtacctaatttatagacgaggaaattgtcattcaaaaagattgactgttatgcccagggtcagcactaacctgcagaaccagtattcagtccccaagttcagtgtcttctactgccctctactaatgaaaagtgaaaatttccctggggtctaattctctcttcagtttgctgtgccgttgtttatctttgagtcttcattctctgaagatggctttctgcctgtttctggtacattagaattctcactatgatatagaaatggcttcagtttcatagcataatcttgcagttagctctgaattgcctcaaaaaccctgaacaacgcgaggttccagatgtgttttacttctttcattcatatttacccccatttgttgtttaaaaagaattatgaacaattattacatcatatgtagaccactttcactgattatatgttgacattttcctcagtaaaacataaagttcttaacaagactatactgtaacacctttctccaacaaaatcagctgtatgttgaaaactattaagtcattgctaatgttttaagccataatacagacagccttatactctatgatgggagaagggaaagtagtttgtccgatggtgctactctgtataaacattactgatgctatctatagtagggcaagaaaagtaaaaagagttttgattattcaggcagcatttttaaaaacctgtgaatttgtatcagttctcatctaaacatttggacacaagtataaaatgaaaacatatgcacaagttatggtttttaagttatctgctcttttttttggtttcactgtacctttgtactcttctattagtgggaataatcagacatgaactgtgacttcacatgtacagtcatacctcacttaatgatggagatgcactctgagaaatgtctaattaggttatttcatcgttgtgggaacatcatagagtgtacttacacaaacctagatagtgtagcctgctacacatgtaggacatgtatatagcctattgctcctaggctacagcatgttgctgttctgaatcatgtaggcaattgtaacacaatggcaagtgtctgtttattcaaacatctaaacacagaaaagatactacaacaataacaatatggtataaaagattttgtaaaaaatctggtcaggtgcagtggttcacgcctgtaatcctagcactttgggaggctgcctcagcaggtggattgcttgagcccagaagctcaagaccagcctgggcaacatggcgaaaccccgtctctgctaaaagtacaaaagctgaggttggaggatcacctgagcctggcaaggtcaaggctgcagtgagccatgatcataccactgcactccagcctgggtgacagagtgactccccatctaaaaaaaaaaatatatatatatatatatactatatatatatatataccatatatatggtatatatatatatagtatatatatatatggtgtgtgtatatatatatatatggtatacctgtatagggcacttactaacggagcttacagaactggaagttgctctggatgagtcagtggtgagtgaatgtaaaggcctaggacattactgtacactactgtagactttataaacaccgtacacttaggtgacactaaaatttataaaaaatgtttttcttctggttgggcatggtgccttatgcctataatcccagcattatgggaggccaaggtgggtggatcactcgaggtcatgagtttgggaccagccgggccaacatggctaaaccccatctctactaaaaatacgataattagccaggtgtggtggcacatgcgtgtagtcccagctaattgagaggctgaggcaggagaattgcttgaatccaggaggtggaggttgcagtgagccaagatcgaaccactgcactctagtctgggtgacagaggagcaagactctgtctcaaaaaaaaaaattctataatttttatagaaataataaaaaactaaccttagcttactgtaaattttctagtttagaaacttatttaaaaacaatttttggactcttctagtaataacgtagcttaaaacacacattgcatagctgtacaaaaatattttccttatatccttattatataagcttttatctatttaaattttgaatttttaaactttttggtcaaaaaccaagacaaacacactagcctaggcctatgcagggtcaggatcaagacatccctagcaggtgacaggaatttttcaactccattataatctgtggggccaccatcatatatatattgtacattgaccgaaacatggttacatgactatataatttgcgtcaatactgctcagtgtgccatatttaaatttacatgactatattgtgatattcttttcaaaataaagtttatttgggagataa

SEQ ID NO: 2426 - DNA, 3462 bp, Homo sapiens
ccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaaatagagaatttgattcctcatttgccacataagtcatctgcttagcttttcctttcctttttttttttttttttttttctggaggcagagtctccctttgtcgccaggctggagtgcagtggtgccatctcggctcactgcagcactgtctcggctcactgcagcctccgcctcccgtattcaagcgattctcctgtctcagcctcctgagtagctgggactacaggtgtgcaccaccacgcccggctaatttttgtatttttagtagagacggggtttcactgtgttggccaggatggtctcaatctcgacctcgtgatccgcccaccttggcctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagcatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgatatta

SEQ ID NO: 2427 - DNA, 1494 bp, Homo sapiens
aaaggccagtggaaggagctcaggcttggcggcatctggtttgcttgtctgggcctactcctttgcatgatataacaaatggcagggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaattttttttt

SEQ ID NO: 2428 - DNA, 2253 bp, Homo sapiens
agacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccaggtactgggatacagcggaggataaagctgacaaaagtccctgccctcaagtcagggttggggtgaacacaagcccgtcctgcagacttaagcagaaaggagtgggaatttattggaaggatctccaattccttgtgagggtccagaatcatggactgagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaa

SEQ ID NO: 2429 - DNA, 2055 bp, Homo sapiens
aggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtagatgagctgctgagcatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgag

SEQ ID NO: 2430 - DNA, 3930 bp, Homo sapiens
ggactggagcgcagcatccttcgaggctgcagccgccacggctgttgccgtaagcaatcctcctgcctcagcctcccgagtagctgggactcgggaccagcctcccgagtattggtcagatgacatttaccatcaccgttttcttcttctttcatcatcatcatcatcaccattgccactaccaccacctccaaggccactaccaccacagcatctctgttcctccatcagagctcttcaagttctgtaaaggcagattctctaaaggcatgcctggtggcatcacgtttttcacatctccgcatctggaccctgcccaagcgaaggctgatctaggcagtctcattgctggagatgactgtcagctgctttctctgcatagccaccatcacatgcctcaccactggagcctgggaagcctgaccacaaaccggcatctccaaggcatgaataattaggtaggcataatggaaggcactcattgtaccctccaattgcataagcccattacggaactctgctacatcagcttctgtcttccaaagggggaagtcagaggattttcatacaagggcactgtaactctagacagatccaataaaggttttcataactgctaccaagtcagggaggagtcagacatcatcagcctcagccaggagccggacgaacatccaggcgacatatttttcaagcagactcccacgaaagacattctaactgagctgtacaaactcacaacagagagggagagactgctaaccaatctcctgagctcagaccacatcctggggatcacgatggggaaccaggaggggaagctgcaagagctgtccgtgagcctggcccccgaggatgactgtttccagagtgctggtgactggcagggagagctccccgtgggccctctcaataagaggagcacccacgggaacaaaaagcctcggaggtctagtggaaggagagagagctttggggcccttccacagaagaggaccaaaagaaaagggcgtggaggccgagaatcagctcctctgatgggcaaggacaagatctgttccagccactcccttcctctttctagaacaaggcctaacctttgggtactagaggagaaaggaaatctgctcccgaatggggcacttgcctgctccctgcagaggagagagagctgccccccagatattcccaagacgccagacacagaccttggctttgggagctttgagacggctttcaaggacactgggcttggaagagaagtgctgccccctgactgcagctccacagaggcaggaggggatggcattcggaggccgccgagcgggctggagcatcagcaaacaggtttgtctgaaagtcaccaggaccctgagaagcatccagaggcagaaaaggatgagatggagaagccggctaagcggacttgcaagcagaaacctgtctccaaagtggtggccaaagttcaggacctgtcctcccaggtacaaagagtagttaaaacgcattctaagggtaaggagacgattgccattcgcccagcagcccacgctgagtttgtacccaaagccgacttgctcaccctcccgggagctgaggctggggctcatggctccaggcggcagggcaaggagcggcaaggggataggtcatcgcagtcgccagccggggaaacagcctccatttctagtgtgtcggccagtgccgagggggccgtgaacaaggtccccctgaaggtgatagagagtgagaagttagatgaagcccctgaggggaaaagactgggcttccctgtccacacgagtgtccctcacactcgcccagaaacgagaaacaagaggagagccgggttgccccttggtggccacaagtccttgtttctggatctgccccacaaagtaggtcctgactcctcacaacccagaggtgataagaagaagccatccccaccagcaccggcagctcttggcaaggtgtttaataattcagcctcgcagtccagcacacacaaacagacgtcacctgttccctcgcctctgtctccaaggctccccagccctcagcagcatcacaggatcctccggctccctgcattgcctggtgagagggaagctgctcttaatgactctccttgtagaaagagccgtgtcttctctgggtgcgtctctgctgacaccttggagccaccatcctctgcaaaggtcacggagaccaaaggagccagcccggccttcctcagagcaggccaacctcggttggtgcctggggaaactttggaaaagagcttggggccagggaagaccacagctgagccccagcaccagtcacctccagccttccattgggatcttcagcagcactttcaggaaccagtcataagaactgtaagcatctcctgtgcttctaaccttataaaagaagaagctggaaaagggaaggagagtagaagtgggtaagagctttttttgatatgggtaacttctctactgtggagacttcctatagggcctccagccattacctcctattggccctactttgaaaggcatgagggagggagttccccagatagtacctttgatttgtatcctctgtctagttcccttttctctcttgattttccctttcctgtcgctgtgagtcctctttatattctgaacccttcagtgactccctgcagctgggaagcccatacagggagaagtttcctgcttccagctacctttgtctttcacttcatttctcttcccacctaaacccagaagagggctcagagagttgccagcagtccagaaagaggggtgaataattcatttaccatcacactacagtgtccctttatctgaacccaactcccacctttctcccaggttagctattaaccagattaagtttatggtctgtggacatttatttcctgtggaaataacatctaggtatttttattgaagtgatgtcattaagattattgaaagctctcattaactgcttaagaaagagattaagtctggcaaaagtaatcagatctgtttccagttggaagactcttcaatgttagaggcaagtagtaattcccaggaaccagtgaaacccgcttatccttgttacaagactaagcagttaaagctgacattaccattcatgcaggatgtagcataaggatgtcacagaggccagcgatgcaccttctgttgggtttgtaatttcttaacttctcatttcaaggatgatgcatgggaatctccattatcaccacatagtggtgataaaatagagaatatactaacaagaactggtagtcaggtttttcttctcctgcctcctcccaccaccaacctggagattggttttatagtattttatttggcgggtggagactgatgtggaatgttcccaagcctttgtggagtatggtcttcccccaaaccttgaggaactctagttgtgctagcctgcaaagcagtgtccttggagcttggtgctaggattcctttctgttttgcttgctttcatttacctttgattcaaagtaaacccttttagtgccagaagaatcacagggagcttggctcaccatacttgggaaatgcccaatctttagtatgctcttgagtaatcctgtggttgttttcctttgactgaagtcactgatgtggtgatggaagcatatgctccaggcatagttcttcctgatattgagaactgagaatctcttgatcaattcttgtgcccatgaaaatatgtaattaatgtcaacttattaagagttaagaggcatacatgaaataaattttatttacatgtgtaaacccctaatactactgtcaaagctttgattgtctctgtggatatacattatgggaagtaaatataaactcttcccatattaatattaaggtttgatgcaattccaataaaattgtaaagaag

SEQ ID NO: 2431 - DNA, 11293 bp, Homo sapiens
atggagaacgttgataattctctggatggcagtgatgtgtcagaaccagcaaaaccagaagccggacttgaagtggctcagtcgatcctgagtaagttctctatgaaatccctatttgggtttacgagtaaattagaatctgtgaatccagaagaggaagatgctgtgctgaaagcattccatagtttagacgtgaatcccacatctcagcaggatgattccagcaatggcttggatccacaggaagcagggtctcgggtttcacctgacctcggaaatgatgagaaaattgcaagcgtggagacagaatcagagggaagtcagagaaaagaagcagggacatctctccttgctcaagagctgcttccactgtctactttgaaagggacaaaagacgatgtcatttgtgttcgtgggaccctggtgcacaccaccagtgattctgactctgatgatggtggccaggagccagaggagggaagcagcaccaatggcccaaagtcccctagtggtgttttatctgagccatctcaggagtccaaagaaaacccaggaggtttcagggaaaatactgtcactggggaaatgaatggtgcagagctctgtgcagaagatcctcaaaggattccacctgagatgagcagcaaactggaagctggcaacggtggtcttcagacagagcgtcgccccagccaggaccaggtgggagaagaagggtcccaagacctacctgcagtaacaaaccagaattcgagtgttggtatcactgagagtgcctcttctaaaaaagaagtctctggagagaagtcattccaacttccagcttttttcagtgggcttcgtgtgctgaagaagggggctaccgctgagggaggagagaccatcacggaaattaaaccaaaggatggggacttagctttgctcaaattgacgcagcctgtgcagaagtccttagtgcaggcagggctgcagacagtgaagagtgagaagaaagcaactgatccgaaggccactcccactctcctggagcagctctctctgctgctcaacattgacatgcccaaaactgaaccgaagggagcagaccctgagtcgcccaggagagaagagatgggctgcaatgctgaccaagagagccagagcggccctggagtaccacaaacccagggtggtgaggtcaagccaaagtcgccagagacagccctggaggcttttaaagccctattcatccggccccccagaaaggggaccacagctgacacctctgagctggaagctctcaagcgcaagatgagacatgagaaggagtcgctaagagctgtgtttgaacggtccaattctaagccagcggatggcccctctgattccaaaagtcctgaccacagcctgactgagcaggatgacaggactcctggcagacttcaagctgtctggccacccccaaagacaaaagacacagaagaaaaagtgggactgaagtacactgaagcagaataccaagctgctattttacacttgaagagggagcacaaagaagaaattgaaaacctgcaggcacagtttgaacttcgggcatttcatatccggggcgagcatgcaatgataacagcgagactagaagaaaccattgaaaatctgaaacacgagctagaacacagatggcgagggggttgtgaagagaggaaagatgtgtgcatttccaccgatgatgactgccctccaaagaccttcagaaatgtgtgcgtccagacagacagagagaccttcctcaagccctgtgaaagtgaaagcaagacaaccagaagtaatcaattagtacccaaaaagctgaatatctcctctttaagccagctctcacccccaaatgaccacaaagacatccatgcagcactccagccaatggagggcatggcatcaaatcagcagaaggcattgcctccgcctcccgcatccatccctccccctccgcccctcccctcaggacttggatctttgtctcccgcacctccaatgccacctgtgagtgctgggccaccgctaccacctccgcctcctccaccgccacctctacctccaccttcaagtgctggacctccaccacccccacccccacccccacttcctaactcccctgccccacccaaccctggagggcctcctcctgctccaccacccccaggacttgcacccccacctccccctggactcttctttggacttggctcttcttccagtcaatgtcctcgaaaaccagccatcgagcccagttgtcccatgaagcctttatattggactaggatacaaataagtgataggagccaaaatgctacaccaaccttatgggactccttagaagaacctgacattcgggaccccagtgaatttgagtatttattctccaaagacacaactcaacagaagaaaaaacctctgtcagagacttatgagaagaaaaacaaggtcaaaaagatcatcaaattgttggatggaaaacgatctcaaactgtgggaatcttgatatctagtttacatttagaaatgaaggatatccaacaggccattttcaatgtggatgactccgtggttgatctggagaccctggcagccttatatgaaaacagagcccaagaggatgagctggttaaaataagaaagtattacgagacatccaaagaagaagaactgaagctgctggataaacctgagcaatttttacatgagttagcccagattcctaattttgctgaacgtgcccagtgcataatcttcagatctgtcttttctgagggtatcacctccttgcacagaaaggtagagatcatcacgcgagcttctaaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggataatgggattaatctggtggactacgttgttaagtattacctgcgttactatgatcaggaagctggaacagaaaagagtgttttccccttgccggaaccacaggatttctttctggcctcccaagtcaagtttgaagacctcataaaagatttgagaaaactgaagaggcaactagaagcaagtgagaaacagatggtggtggtgtgcaaggagtccccaaaggagtatctccagcctttcaaggacaaactagaggagttcttccaaaaagccaaaaaagagcataagatggaagaaagtcacttggagaatgcacagaaaagttttgaaacaacagtacgatattttgggatgaagccaaagtctggtgagaaggagatcacacccagctacgtgtttatggtgtggtatgagttctgcagtgacttcaagacaatttggaaacgggagagtaaaaacatatctaaagaaagattgaaaatggctcaggaatcagtcagcaagttgacttcagagaagaaagtggagacaaagaaaatcaatcccactgctagcctgaaagaaagactgcgtcagaaggaagccagtgtgaccactaactaagatgaagacacatggaaatgatggcactggaggtggaggaccttgcacgcatactctttgtgaccacagggttgcaggacgttcttgaaagatgtgtcactaaatgtttgtttttgctcatctctttctgaggtcatctgcagagagtgccccatgccttctttaagaagtccctcattaagccgcaggaacaatggaaaactatttaagggaacattgcagaaatatttgatgactgtttcttgtggaagcccaaagtccactctaagagcagaagaaataccaaaatgtttccaaaatttttttaaaagctgagatttccagctttataaccaaagcttgatatatgtcacattgtcacagaagagagaaaagatcattgaggacagttgccttgggagagttcaagtctttgtcgttacacactgctgttttgattattggtcttagttttgatcctgttgcagcaaaatcctgcagcatctttctctccaataatgttgcaactcaccaaaactattcttgaagaggtccaagaacatgtattatccagactaaaaaaatgattttttgttgttatggtttacgtgatgaaaaggagaaaaaacagaatcatacctgggtggagagagggagacaaatagccataaacttcatcctggagaacaagttaccatgcaaggagttgacatcagttgttaagtgaggcccattcttgtttttacatcggtcctttgtggtttttctgggccagcagagattctgcaccccaactcccaggagaaaatgtaatacctgagcaagcacagccttgggtgtgcttggacaagagacccagcggcagagcaccttttacattttggaccgttcatgaatgggcaatgttgtgttgatacgcagccgagttctacgttatgtgctgtgactgtgcagctggacgacccccatccccaggaggcagtttccagacaggagagcaaatgcaactcacagcacctgctcatgaccttggctgataggcatgtgaagtaggatgaagcaggactctttaatgtcaaaaaaactgaagggcagaaaaaaggttccttacatcaaaatgaaagtaattacattaatagaaaacttccaagtggaatattgttcacaggcagctctttctgaccctggctcttgagtcacataaggaaaccacctttgacctctctgacacttttgtctttaagccacgtctctgaaatcttgtgaggggtgaagaaagaggactggagatgaatggacaatatgatcaaagactcatttttaggccttgaagaggccgagctttctccccccaattggtggaggacagtccagagatgagcagaaatcttaaattccttcctgatccagcctccacatgtggcctgccccttgccccagcatctttccagaacccctggacttgccaggtgcctgagcatcttcccaggatatgcctgccagccagcagcccctcaggaatgcttctataatagatccagtaatgaaagcagcaccatatcctaatctaatgtcagcttcgagaatgaagactgcagtcaggatcaaatcaagtcacagaagccatattcatgcaggtgctaaccgccttttctactggtgcaactgaaaggaatatggtaacatggttggatttttaaaattcacaatgaaggaacgagacaagcaaaacagaaaagccgagaaggaacatgcatgactaaaaaggcttgaagttgcttgtgagcaagaagctttttatgctgctttcttacatagtttctcttcattttcacttaactctgaagacaaccaaaagaacggatcaattaaaaactgattccacttataaccattgtatgctccttctagtgttatcatgcacaagaaaagtgccagttttacccatgccatataattcagctcttttgagttatgtggggccagcagaagtctcaatccttataggcttgatggtgagagcagcgggaggtttgaggtgtactcattgcagtccactttggtctgtaagtaggatgcttacgagaaatcagtgaaggtaagcagggctgccactgtggccacgtaacccttcaggaaccagtgctgaagaataatgagtgagaacacttaatttgagagttagacaaatacagcccactttggatttcatcctagtgaacagactaaaactttgcagtaaaatacctatttctacaaagcaaggtttgcctgcctcggttggggaaacctagtggttttgtcacactagtcgatgtatgatgttagtgttgtaagacaccatggcagaatcttcattattctcacctattctgaaccctgcatcatgtatctgggatgccccctcccaagtccaccaatgtaccacgttgctgacacagccttcatttttaactcaaattgatgctcagtaaaggtcaatgacaatttgttcaaggaagttcatctaaaataatctggaggccttgaaaatgatccctctaaaatgctgttgagcttgtgttcagtgtagcaggaggatctgaacttttcctggagaggaggtgatcgggatgccatttggcagcttaagcacatcctgccagcaggctttaagtggctgttctaggcatagccctccctgaactagaaaggagagtaaccagtttgctatgctgcatctaaccagacacacctgacttagtagtaactctaagaacccttaacttacaaacaactttgtctcctcttagacaatattcattaaatctgaggacacagtttgacagtagttcagattcttgcatgagcaattgacagcatcagagcacacaatatcataagttacataaattacacaaagtacatcataaattacactacagacacgttaggtaaaaagcatcaggcccgggccgggcgtggtggctcatgcctataatcccagcactttgggaggccaagcgggggcggatcacgaggtcaggagattgagaccatcctggctaacacggtgaaaccccatctctactaaaaatacaaaaaattagccgggcgtggtggtgggcgcctgtagtcccagctactcgggaggctgaggcaggagaatggcgtgaacccaggaggtggagcttgcagctagccgagatagcaccactgcactccagcctgggcgacagtgagactccgtttcaaaaaaaaaagcatcaggcccatgaagtatcaaaaaccaggttaggaggtgtgctgtatggcttttatctcaataagtggcagcttactggggaaaaagaaataagaaaaagtgtggccaagcagaagtggatgtttatgatgacggtgggggcccagaggtcataggtgatggtcctactgcccaacagttgccttttgaatccttatgttgatgatggtgtctttctacacactcactgcaactactcaggaattataaagattttctgaaatctgagaagtggaataaggaaacccagtggagctattacacttttaaatgttctagccaaaacaaattgccagtatggttgaggaattgaatatcagatggcatgcagtctcccctcccctcccctatcaaggacagtagaagctgcaaacctcttctcagcctccttcaggcacctcctgttttcataagcaccatgaagaatggtgtttcctaaatgaaaagttcagatactgctggtaaagaaactggaaaaactgaaggaaggaataaaatatgttggtggtattaacacctccagtaagataagtcattggtacggtttttctaagggccgcagtgagatgtagcagaagaaatatgtttattttgggcaaagatttgcttattggcctgggattgcacattttctctatgatgtttgcaacagagaaattttcattttaatgatactcttcctttcttgaaagttacatgtcctcatttctgtttctgcttctcccttggccagtgtcattgatgcagatcattgcatacaacagcacagcaaattgcgccaagtcagtgtgtgaatgggaattagcaatgcacgcttgcaggctctttttccaggaaccaggctgtaacattgaccggggaacctcttcattccctgacatactaaattggtcaattttgtagtactcatctccatccacaaaaacaacaaagataaaatcaatttggagctttatatgacaaaaaggaagaagtccaaaaatatatagccttcccccctcccacatatctgatccaaatattaaatatctgattttataaaacagtttaaattgtctttttaaattgctaacaagcatcagttatatttgagcttcatttttcttttatcctgtctgtcctaataaaaacaaaaatggccaaaaagtggagaggaaagaaaaagcttccactttttaaaatttgttttgtattagttattttacctttagggaccctacaactgaagagagtggagagaataaagaagtgaactttcattcatgtctgctactttgacctcataaagaaatctgcaacacagatgaaaccagtctgtgtggccaagctgatgggatttgaaaagagtggataatttttagcctttccaaaatgcaaataacttggatatatttccattttccagctatagagagaaacaatccagctgcctggaaactgttattagtatagaagtggcttaaagaaaagcatcttcaaatacttgacttagcatatctttcttctttagacttacataatgatattcatctctccattagcaattgaatccaggcataaccgggctcagttacacagcttgtctgtgactgggaagcccattttgtgtcatttctgcacacctgtccgctgttgacaccttattagaggcactgcattttggtttcacaattcttcatctcccttcccaaggaatgggcaatctactgaacttccagatcaatgctttgttggaaagtgatgaatttaagagagttttaacatgtcaaatttgaagccaattcagtatccttatttgttccaagactcttaaccaatactgtgatataaagttaggatttgggaaacgtgtagttaacaacttggaaacatgaagatattaaaatggcagctggctaactgtctcttaagccactatgcaatttctaccaatggagagattagggaagcaaattaagcctcattcagtaggtctgctgtctggtggaacttacggaactcatttcctcctctatccccagcccttctcctaactatggtgataaccagggccatagaagaccttttctctcttacctttctctgataggatcgtgtccttcagtcaagagctcatgtgaactccagactttatattacatctctgaagttcttgatgtggggaagattgacttttattccatttttatatgaaggtgttagatatagccatcaatttatttttctacattccctctacgcttatgtaattttctatttttaaatcttctcttaaatatactgagaatctctagtctccttttctaaaggctgatccaactacacttgtgggctatttttccaagctttgtgtgaaacttgatgacattgggccagcaaaatgcaaagaagactatagtttcaggcagaaaatcacgtccaaagaatttggcatggattaaacaacctctaccacactatagctctcacataggctgaacattttcctaaattctacctgtgcagacactgaggggctctctacctttgaaactatgagaacgtcttaaattaatatgaatatttctctccatgtatagtgtgagctgccaatgcattatcttaatacatcaagaaggaaatcagatttcaggcacacattagcaattgtttgttaatgtccttggcaaacgtgtacctgctttccttcattgttctcttcaggggctttcttccactttcctcttatgaaacgaatgtgtttttgactgttaactgggttcgctttccagatctgtctttcccaaatgaaaggttagtcccatagaccactggctattcagggaaattactctctacctccccatgacatggatgataagtgttgagggatgaacactctggaaactcttagcatggattttgaattccagatttctttataggagatgtataaaaaggagtttatagcatacaaaaattatactgctcttcccagtaagggactaaaaggacatttgaaatctttacattttagatgtttttgtgaattataaatatctcctttttcctcgcttcatgctaacttgtctctagataaaatcttatttcttcatacattggaccacaaggcataaagaaggtagctcagcgccactgagattgtgttctgcataatatttggaaggcttccatttccattgaaaacaaatccatgagtgagagggaaagtctagtatcaattcttctgtttgctcgcaatgacacaaataggttttggggatctacctaagggataggtctactccaaaattattaaatttataattgtgcaattctgtaatttcccaaggcataagtaatatgaccctactgtcagctagatgtcttatcttcaaagagagtatgcattaataaaaagaacttccctttaaagaaccaatctaaaatactaaaaaggcagaaacttttaaaattagaaattggataatttttaagaatctttagagaaaacattggtttatcatagtctttttctttcattgagttttcatttagactagcatggcaagcagggtggccttggactttgatttaggggatcgtgctttggcctggaaaataagcactggcctgcatgcctagaacctgagtgaaggcagtcaacatcctagtatgaatcagacctagcagaaatgtaaattatttcaagtacttcagggtttagttttcttagtgacaccctggaccctggatgctgctttctaaagtgcacctgatccatgcagttttatgtcttcatataactggtatcttgtgagtttgcaagcaatgggatgagcaagaaaaaaaggacgcatggaggagaaaaatttgaacgaggctagtgcaatgttttgctgatagattacattgttagggagctggtgattttttgccatggtcgtatcgtggacagcttttccgtggaaattcaaggcatctgtattaggcaaatgtgagtgcccttgatcttgtattgatcagtgccaatgtactgggaaagcaggtaccccagtgaaactggtctgtgcttggtttaacagctccaacaatttcagatccatggggctgcttgaccatagaccctgtttactccatgcctgttcaaaagtcattttgacttctagctttgtttcactttcttctttcaatacttctgtttcctcgtccttttccttcatattccatggctatttctttcctactttacagtttcccccagacccagattttttcacacctctgcatcatagacaactgagtagctcccttggcccctcctccatcctctcacaccctgtgctccgttcctcagccgtttggacagggagctccgctgtcaccaaggagcccatgtgagacacactgctgtgactgcctcttgttaatgtcagcatcacctcatcacttaagcaaaaa

SEQ ID NO: 2432 - DNA, 4060 bp, Homo sapiens
tccctggtccgtgtgtagtaaggtgcgcagcctcggctgcttctgggcatagactccacagatttttcacagttgccctggaacacatcatcgcacaaaccggaaggagggcactgtgacccgaaagagaccaagtgtgtttgctgtgcggctgacagcctgactcccgggtcctgttgctctctgtcctgtaaattaagagcagatggagtggataaactgagagcgcaggagaaggtaacacaagtcagaacttccaccaagggcattactgagacatggagaacgttgataattctctggatggcagtgatgtgtcagaaccagcaaaaccagaagccggacttgaagtggctcagtcgatcctgagtaagttctctatgaaatccctatttgggtttacgagtaaattagaatctgtgaatccagaagaggaagatgctgtgctgaaagcattccatagtttagacgtgaatcccacatctcagcaggatgattccagcaatggcttggatccacaggaagcagggtctcgggtttcacctgacctcggaaatgatgagaaaattgcaagcgtggagacagaatcagagggaagtcagagaaaagaagcagggacatctctccttgctcaagagctgcttccactgtctactttgaaagggacaaaagacgatgtcatttgtgttcgtgggaccctggtgcacaccaccagtgattctgactctgatgatggtggccaggagccagaggagggaagcagcaccaatggcccaaagtcccctagtggtgttttatctgagccatctcaggagtccaaagaaaacccaggaggtttcagggaaaatactgtcactggggaaatgaatggtgcagagctctgtgcagaagatcctcaaaggattccacctgagatgagcagcaaactggaagctggcaacggtggtcttcagacagagcgtcgccccagccaggaccaggtgggagaagaagggtcccaagacctacctgcagtaacaaaccagaattcgagtgttggtatcactgagagtgcctcttctaaaaaagaagtctctggagagaagtcattccaacttccagcttttttcagtgggcttcgtgtgctgaagaagggggctaccgctgagggaggagagaccatcacggaaattaaaccaaaggatggggacttagctttgctcaaattgacgcagcctgtgcagaagtccttagtgcaggcagggctgcagacagtgaagagtgagaagaaagcaactgatccgaaggccactcccactctcctggagcagctctctctgctgctcaacattgacatgcccaaaactgaaccgaagggagcagaccctgagtcgcccaggagagaagagatgggctgcaatgctgaccaagagagccagagcggccctggagtaccacaaacccagggtggtgaggtcaagccaaagtcgccagagacagccctggaggcttttaaagccctattcatccggccccccagaaaggggaccacagctgacacctctgagctggaagctctcaagcgcaagatgagacatgagaaggagtcgctaagagctgtgtttgaacggtccaattctaagccagcggatggcccctctgattccaaaagtcctgaccacagcctgactgagcaggatgacaggactcctggcagacttcaagctgtctggccacccccaaagacaaaagacacagaagaaaaagtgggactgaagtacactgaagcaggtaatgtgaaaggaagctagggacccgggaatgaatctcttcctgcaatggcttttagttctagcttagttgactctcagaatttggggttttatttcattataaaatgtaatgctgaagggtttctttttggttttgctgttaaagtgaacctttgcacacttattgttaacgagcctctgaaagatgaaagatgaatgcagtggaatgaatgaaagggggaatgtgtgtgaagtaggagaaccttgggggacctgatggagaaggtagattgcaaatccctcaggaagccggtggttggtcctcatacaattttgtgagctggcagtgttgctagaagaggcagagtatggttctctagagctgtaatctgatttgttgtttgtcttcgagtaatgcttttgagataaaggaaccttgtgcagagtgaatgtacagataccgtatcagttactcgttcacttttgtgagacaaagctttatttaatgcatggccaactttaaagcaacctaactctctggaaacctgcctaggaactttacttgaatttatttaaatgaaatgggaatctagatatggttactatttaagtggaagtttcacgtgaactgtaaaatgacaccaaagcattagaggatgggtatgtaagatattaagaattgcatgtgtgtgtatatatccatgaaacctctctgccttcttcctgatatttggagattacctatacgtggcttatatttgttgtttttattaggtgtatgtgtgcattgaggtctatctatctatctggttatagaaaaataacttctttccattcctgttcattgatagacatgaacagatcaaagttgggtggttcagtaggtttttccataatatcaaattactccagtgattgagaacacactggcagttgaatcttgagatgatttctagctttcatttacacagtttctgcagggcattggttacttcatagcattttctttctgtggtgtttgacttacaggatgaaaactcatatccttaatgaaaatatgtatagcaatttaagtcttctttcccacatttgattttccaaaaatcataattgtgtaagaatgaacagcataagggtggaaaatgattgtttcatctgagcagagcaattcagacacagcagtaaagaaagcataaggatgttctaggtaattgaagcatagaagtagcatagggctaaacttctgtttaacccaaacttgaatggaaaatttcctaaaccacattagatcacttttttccttttgctttgtttagtccaaacgcacttaactttattttctctagggtaattacatatatgactgtatcaatgagggtcgtactaatcaggaatcaggtggcactcaaatggagtgatttgaggagagtttattagagacctttcacagaggtacagacggggtttagaaaaagcagtaagagagcgctactctggggccagtaccaaggagaagcttttaccacacccaagcctgaaggggcaagagtagaagtcgctatcgaaaactagaacttaagagggaggctgagtggtgtggaggcagctgctgggcaggacccgcagccctcagcagggaggtgccgccggtccatagtgacatgccaggctgggaactgagggcacacaacctgatctcttctcatcccactctctggtccctcatcgtcattcccattggccaaacccaaagagaagtcagcagactgggagccacttgaggctatcatttcaggcctgtcaccggggcccagaaagggcacagacctggagaagcacgtagaagatcccctgcacagttatggtaccaccatgggcgcccagcaggccctgggcagagagacttctaaagccctcctggagaagaatctgcacagacatgctggtgttgtcataccacacgacacgggagtttagtacaagggcacaaagacaagcttctgttattatcatcctgtgggagggttatattttctagtataatcagttcatagaaaatatacagctattattcgaggcttgctctgtagaaaactacttcattttaatgtgagggatttgtttactgatctcagaaaatctctcataaggttttaaatgttccccaaataaagtaaaatttgaagatatccagaaaaatcatgaagcaaaagaaactttctatgattctatttcagagaaactgttgtcacttttgaaactaggcctatgaatttaatgtggaaaaataaaaatagaatttgaatcat

SEQ ID NO: 2433 - DNA, 4260 bp, Homo sapiens
atggaaggcactcattgtaccctccaattgcataagcccattacggaactctgctacatcagcttctgtcttccaaagggggaagtcagaggattttcatacaagggcactgtaactctagacagatccaataaaggttttcataactgctaccaagtcagggaggagtcagacatcatcagcctcagccaggagccggacgaacatccaggcgacatatttttcaagcagactcccacgaaagacattctaactgagctgtacaaactcacaacagagagggagagactgctaaccaatctcctgagctcagaccacatcctggggatcacgatggggaaccaggaggggaagctgcaagagctgtccgtgagcctggcccccgaggatgactgtttccagagtgctggtgactggcagggagagctccccgtgggccctctcaataagaggagcacccacgggaacaaaaagcctcggaggtctagtggaaggagagagagctttggggcccttccacagaagaggaccaaaagaaaagggcgtggaggccgagaatcagctcctctgatgggcaaggacaagatctgttccagccactcccttcctctttctagaacaaggcctaacctttgggtactagaggagaaaggaaatctgctcccgaatggggcacttgcctgctccctgcagaggagagagagctgccccccagatattcccaagacgccagacacagaccttggctttgggagctttgagacggctttcaaggacactgggcttggaagagaagtgctgccccctgactgcagctccacagaggcaggaggggatggcattcggaggccgccgagcgggctggagcatcagcaaacaggtttgtctgaaagtcaccaggaccctgagaagcatccagaggcagaaaaggatgagatggagaagccggctaagcggacttgcaagcagaaacctgtctccaaagtggtggccaaagttcaggacctgtcctcccaggtacaaagagtagttaaaacgcattctaagggtaaggagacgattgccattcgcccagcagcccacgctgagtttgtacccaaagccgacttgctcaccctcccgggagctgaggctggggctcatggctccaggcggcagggcaaggagcggcaaggggataggtcatcgcagtcgccagccggggaaacagcctccatttctagtgtgtcggccagtgccgagggggccgtgaacaaggtccccctgaaggtgatagagagtgagaagttagatgaagcccctgaggggaaaagactgggcttccctgtccacacgagtgtccctcacactcgcccagaaacgagaaacaagaggagagccgggttgccccttggtggccacaagtccttgtttctggatctgccccacaaagtaggtcctgactcctcacaacccagaggtgataagaagaagccatccccaccagcaccggcagctcttggcaaggtgtttaataattcagcctcgcagtccagcacacacaaacagacgtcacctgttccctcgcctctgtctccaaggctccccagccctcagcagcatcacaggatcctccggctccctgcattgcctggtgagagggaagctgctcttaatgactctccttgtagaaagagccgtgtcttctctgggtgcgtctctgctgacaccttggagccaccatcctctgcaaaggtcacggagaccaaaggagccagcccggccttcctcagagcaggccaacctcggttggtgcctggggaaactttggaaaagagcttggggccagggaagaccacagctgagccccagcaccagtcacctccaggtatctcctctgagggctttccctgggacggcttcaatgagcagacacctaaagaccttcccaacagagatggaggcgcgtgggttctgggctacagagcgggaccagcctgtccatttttgcttcatgaggaaagggagaagtcaaacaggagcgaattgtacttggatctccatcctgaccacagcctgactgagcaggatgacaggactcctggcagacttcaagctgtctggccacccccaaagacaaaagacacagaagaaaaagtgggactgaagtacactgaagcagaataccaagctgctattttacacttgaagagggagcacaaagaagaaattgaaaacctgcaggcacagtttgaacttcgggcatttcatatccggggcgagcatgcaatgataacagcgagactagaagaaaccattgaaaatctgaaacacgagctagaacacagatggcgagggggttgtgaagagaggaaagatgtgtgcatttccaccgatgatgactgccctccaaagaccttcagaaatgtgtgcgtccagacagacagagagaccttcctcaagccctgtgaaagtgaaagcaagacaaccagaagtaatcaattagtacccaaaaagctgaatatctcctctttaagccagctctcacccccaaatgaccacaaagacatccatgcagcactccagccaatggagggcatggcatcaaatcagcagaaggcattgcctccgcctcccgcatccatccctccccctccgcccctcccctcaggacttggatctttgtctcccgcacctccaatgccacctgtgagtgctgggccaccgctaccacctccgcctcctccaccgccacctctacctccaccttcaagtgctggacctccaccacccccacccccacccccacttcctaactcccctgccccacccaaccctggagggcctcctcctgctccaccacccccaggacttgcacccccacctccccctggactcttctttggacttggctcttcttccagtcaatgtcctcgaaaaccagccatcgagcccagttgtcccatgaagcctttatattggactaggatacaaataagtgataggagccaaaatgctacaccaaccttatgggactccttagaagaacctgacattcgggaccccagtgaatttgagtatttattctccaaagacacaactcaacagaagaaaaaacctctgtcagagacttatgagaagaaaaacaaggtcaaaaagatcatcaaattgttggatggaaaacgatctcaaactgtgggaatcttgatatctagtttacatttagaaatgaaggatatccaacaggccattttcaatgtggatgactccgtggttgatctggagaccctggcagccttatatgaaaacagagcccaagaggatgagctggttaaaataagaaagtattacgagacatccaaagaagaagaactgaagctgctggataaacctgagcaatttttacatgagttagcccagattcctaattttgctgaacgtgcccagtgcataatcttcagatctgtcttttctgagggtatcacctccttgcacagaaaggtagagatcatcacgcgagcttctaaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggataatgggattaatctggtggactacgttgttaagtattacctgcgttactatgatcaggaagctggaacagaaaagagtgttttccccttgccggaaccacaggatttctttctggcctcccaagtcaagtttgaagacctcataaaagatttgagaaaactgaagaggcaactagaagcaagtgagaaacagatggtggtggtgtgcaaggagtccccaaaggagtatctccagcctttcaaggacaaactagaggagttcttccaaaaagccaaaaaagagcataagatggaagaaagtcacttggagaatgcacagaaaagttttgaaacaacagtacgatattttgggatgaagccaaagtctggtgagaaggagatcacacccagctacgtgtttatggtgtggtatgagttctgcagtgacttcaagacaatttggaaacgggagagtaaaaacatatctaaagaaagattgaaaatggctcaggaatcagtcagcaagttgacttcagagaagaaagtggagacaaagaaaatcaatcccactgctagcctgaaagaaagactgcgtcagaaggaagccagtgtgaccactaactaa

SEQ ID NO: 2434 - DNA, 1021 bp, Homo sapiens
ggaagcttctgggccacggactgccggaccgttgggctgtgaggcagcgtctcagcgaggcggcacccggagccatgtcttcacataggaggaaagcgaaggggaggaataggagaagtcaccgtgccatgcgtgtggctcacttagagctggcaacttatgagttggcggcaactgagtcgaatcccgagagcagccatcctggatacgaggccgccatggctgacaggcctcagccaggatggcgggaatctctaaagatgcgggtcagcaaaccctttgggatgctcatgctctccatttggatcctgctgttcgtgtgctactacctgtcctactacctgtgctccgggtcctcatattttgtgcttgcaaatggacatatcctgcccaacagtgaaaatgctcatggccaatctctggaagaagattccgcattggaagctttgctgaattttttctttccaacaacttgcaatctgagggaaaatcaggtggcaaagccttgtaatgagctgcaagatcttagtgagagtgaatgtttgagacacaaatgctgtttttcatcatcggggaccacgagcttcaaatgttttgctccatttagagatgtgcctaaacagatgatgcaaatgtttgggcttggtgcgatcagccttatcctggtatgtctgcccatttattgccgctctcttttctggaggagcgaaccggccgatgatttacaaaggcaggacaacagagttgtaacgggtttgaagaaacaaagaaggaagcgaaagaggaagtctgaaatgttacagaaagcagcaagaggacgtgaggaacatggtgacgagtagcaagagaccaaagcattattttcccctcaagacaacagaaaccattcagagcagaggggactgtctcagccatgcaaacctcatggagcattttggaaagttaaaaattgattcttatttttgtcatgtttactttcaaacatgaaataaaattgagttctgttttcatgcatcaaacc

SEQ ID NO: 2435 - DNA, 923 bp, Homo sapiens
cggcggccccatggacctgcccccgcagctctccttcggcctctatgtggccgcctttgcgctgggcttcccgctcaacgtcctggccatccgaggcgcgacggcccacgcccggctccgtctcacccctagcctggtctacgccctgaacctgggctgctccgacctgctgctgacagtctctctgcccctgaaggcggtggaggcgctagcctccggggcctggcctctgccggcctcgctgtgccccgtcttcgcggtggcccacttcttcccactctatgccggcgggggcttcctggccgccctgagtgcaggccgctacctgggagcagccttccccttgggctaccaagccttccggaggccgtgctattcctggggggtgtgcgcggccatctgggccctcgtcctgtgtcacctgggtctggtctttgggttggaggctccaggaggctggctggaccacagcaacacctccctgggcatcaacacaccggtcaacggctctccggtctgcctggaggcctgggacccggcctctgccggcccggcccgcttcagcctctctctcctgctcttttttctgcccttggccatcacagccttctgctacgtgggctgcctccgggcactggcccgctccggcctgacgcacaggcggaagctgcgggccgcctgggtggccggcggggccctcctcacgctgctgctctgcgtaggaccctacaacgcctccaacgtggccagcttcctgtaccccaatctaggaggctcctggcggaagctggggctcatcacgggtgcctggagtgtggtgcttaatccgctggtgaccggttacttgggaaggggtcctggcctgaagacagtgtgtgcggcaagaacgcaagggggcaagtcccagaagtaacgccactgct

SEQ ID NO: 2436 - DNA, 2051 bp, Homo sapiens
atgctgccggactggaagagctccttgatcctcatggcttacatcatcatcttcctcactggcctccctgccaacctcctggccctgcgggcctttgtggggcggatccgccagccccagcctgcacctgtgcacatcctcctgctgagcctgacgctggccgacctcctcctgctgctgctgctgcccttcaagatcatcgaggctgcgtcgaacttccgctggtacctgcccaaggtcgtctgcgccctcacgagttttggcttctacagcagcatctactgcagcacgtggctcctggcgggcatcagcatcgagcgctacctgggagtggctttccccgtgcagtacaagctctcccgccggcctctgtatggagtgattgcagctctggtggcctgggttatgtcctttggtcactgcaccatcgtgatcatcgttcaatacttgaacacgactgagcaggtcagaagtggcaatgaaattacctgctacgagaacttcaccgataaccagttggacgtggtgctgcccgtgcggctggagctgtgcctggtgctcttcttcatccccatggcagtcaccatcttctgctactggcgttttgtgtggatcatgctctcccagccccttgtgggggcccagaggcggcgccgagccgtggggctggctgtggtgacgctgctcaatttcctggtgtgcttcggaccttacaacgtgtcccacctggtggggtatcaccagagaaaaagcccctggtggcggtcaatagccgtggtgttcagttcactcaacgccagtctggaccccctgctcttctatttctcttcttcagtggtgcgcagggcatttgggagagggctgcaggtgctgcggaatcagggctcctccctgttgggacgcagaggcaaagacacagcagaggggacaaatgaggacaggggtgtgggtcaaggagaagggatgccaagttcggacttcactacagagtagcagtttccctggaccttcagaggtcgcctgggttacacaggagctgggaagcctgggagaggcggagcaggaaggctcccatccagattcagaaatccttagacccagcccaggactgcgactttgaaaaaaatgcctttcaccagcttggtatcccttcctgactgaattgtcctactcaaaggagcataagtcagagatgcacgaagaagtagttaggtatagaagcacctgccgggtgtggtggctcatgcctataatcccagaactttgggaggctgaggcaggtggatcacttgaggtcgggagattgagaacatcctggtcaacatgggaaaaccccgtctctactaaaaatacaaaaaaattagctgggcatggtggcacatgcctataatcccagctactctggaggctgaggcaggagaatccttgaacccgggagttggaggttgcagtgagctgagatcacgccactgcactccagcctagcgacagagcaagactccatttaaaaaaaaaaaaaaaaaaaaaaagaagcaccttcaggctggagaagcagcgtagctaacacaagtccagtccttgtgatgtggctggtagttggggatggccaggctgaagcagagagtcctagagaaatctcgatacaagcttcaaagcaacacctagacactgctctagcggttgatcctggagataaaccaacaagagagagatggaagagaaatactaaatgaggtcaaagaagactcagaaaggttctgagcctggagatgagcagggaggcctcagggcttagacctttaatgataggggtttccctgcattggtttgacctgttgcctttttgatgtgctctgtttgttttcatgtgttgtcttgtctcccctgctaaactgggagctgccaggggtctgggtcttatctccttcctccatggtaccccacacaggccaggatgtggtttggtacccagcaatcagagattggcactccctcatacaggggaaagcaacctggtctagcaaattgaaaataaagatgataaaactctg

SEQ ID NO: 2437 - DNA, 1656 bp, Homo sapiens
gagacagcaaggtgctgtgcggcagagcatttggggtctcaaagaagcagtggccaccaccatggatacaggccccgaccagtcctacttctccggcaatcactggttcgtcttctcggtgtaccttctcactttcctggtggggctccccctcaacctgctggccctggtggtcttcgtgggcaagctgcagcgccgcccggtggccgtggacgtgctcctgctcaacctgaccgcctcggacctgctcctgctgctgttcctgcctttccgcatggtggaggcagccaatggcatgcactggcccctgcccttcatcctctgcccactctctggattcatcttcttcaccaccatctatctcaccgccctcttcctggcagctgtgagcattgaacgcttcctgagtgtggcccacccactgtggtacaagacccggccgaggctggggcaggcaggtctggtgagtgtggcctgctggctgttggcctctgctcactgcagcgtggtctacgtcatagaattctcaggggacatctcccacagccagggcaccaatgggacctgctacctggagttccggaaggaccagctagccatcctcctgcccgtgcggctggagatggctgtggtcctctttgtggtcccgctgatcatcaccagctactgctacagccgcctggtgtggatcctcggcagagggggcagccaccgccggcagaggagggtggcggggctgttggcggccacgctgctcaacttccttgtctgctttgggccctacaacgtgtcccatgtcgtgggctatatctgcggtgaaagcccggcgtggaggatctacgtgacgcttctcagcaccctgaactcctgtgtcgacccctttgtctactacttctcctcctccgggttccaagccgactttcatgagctgctgaggaggttgtgtgggctctggggccagtggcagcaggagagcagcatggagctgaaggagcagaagggaggggaggagcagagagcggaccgaccagctgaaagaaagaccagtgaacactcacagggctgtggaactggtggccaggtggcctgtgctgaaagctaggtcctccgggggaggagggtgtagctggcatgtcatcctcagggcgcttcctcgctcacgccaggagggacttggagtggcgagctggggcccgatggggcttgggggcagagtagacatctagcctccctaagggtatgcgcgctaaagcccagctctcgatctcacctccatccccatccacccacacactatggattgggctctgggaaggggtcagggtgagaggctgctctggagaacaatgaggtcctcatagcagcaggcagctcctgtgttttcttgagggtggcagaggagctaagagcagtgcccagggtctgagggggctgcccagtgagtggcaggggcaggagaggggagaaccccatcctcagagctgctcccagccagcgagtcaggagcgggggagacagggctccagggatgaggccgcattctgctcccacagcgccttttccagaaagttcccattgctcaataaatgtggatcatcagagacatttatgaacaatgacagaagaaaaattacccaaataaatgtggaagcaagc

SEQ ID NO: 2438 - DNA, 6708 bp, Homo sapiens
ctcccggccccggggagaacgcacggcctgcccctgcccggctccgtctggatcatgcggggggctcccgaggaggagagggcgagtgaccggcctgcgccgcccctgttctgggggcgccccccactctgagtcgcccccacctgctgccatgtgccgctgccacgggtacccagcctgtcgctaaactttccgggcgccagcccggctctgagtcgcgcttctcagcggagtgacccagggacggaggacccaggctggctggggactgtctgctcttctcggcgggatccgtggagagtcctttccctggaatccgagccctaaccgtctctccccagccctatccggcgaggagcggagcgctgccagcggaggcagcgccttcccgaagcagtttatctttggacggttttctttaaaggaaaaagcaaccaacaggttgccagccccggcgccacacacgagacgccggagggagaagccccggcccggattcctctgcctgtgtgcgtccctcgcgggctgctggaggcgaggggagggagggggcgatggctcggcctgacccatccgcgccgccctcgctgttgctgctgctcctagcgcagctggtgggccgggcggccgccgcgtccaaggccccggtgtgccaggaaatcacggtgcccatgtgccgcggcatcggctacaacctgacgcacatgcccaaccagttcaaccacgacacgcaggacgaggcgggcctggaggtgcaccagttctggccgctggtggagatccaatgctcgccggacctgcgcttcttcctatgctctatgtacacgcccatctgtctgcccgactaccacaagccgctgccgccctgccgctcggtgtgcgagcgcgccaaggccggctgctcgccgctgatgcgccagtacggcttcgcctggcccgagcgcatgagctgcgaccgcctcccggtgctgggccgcgacgccgaggtcctctgcatggattacaaccgcagcgaggccaccacggcgccccccaggcctttcccagccaagcccacccttccaggcccgccaggggcgccggcctcggggggcgaatgccccgctgggggcccgttcgtgtgcaagtgtcgcgagcccttcgtgcccattctgaaggagtcacacccgctctacaacaaggtgcggacgggccaggtgcccaactgcgcggtaccctgctaccagccgtccttcagtgccgacgagcgcacgttcgccaccttctggataggcctgtggtcggtgctgtgcttcatctccacgtccaccacagtggccaccttcctcatcgacatggaacgcttccgctatcctgagcgccccatcatcttcctgtcagcctgctacctgtgcgtgtcgctgggcttcctggtgcgtctggtcgtgggccatgccagcgtggcctgcagccgcgagcacaaccacatccactacgagaccacgggccctgcactgtgcaccatcgtcttcctcctggtctacttcttcggcatggccagctccatctggtgggtcatcctgtcgctcacctggttcctggccgccggcatgaagtggggcaacgaggccatcgcgggctacgcgcagtacttccacctggctgcgtggctcatccccagcgtcaagtccatcacggcactggcgctgagctccgtggacggggacccagtggccggcatctgctacgtgggcaaccagaacctgaactcgctgcgcggcttcgtgctgggcccgctggtgctctacctgctggtgggcacgctcttcctgctggcgggcttcgtgtcgctcttccgcatccgcagcgtcatcaagcagggcggcaccaagacggacaagctggagaagctcatgatccgcatcggcatcttcacgctgctctacacggtccccgccagcattgtggtggcctgctacctgtacgagcagcactaccgcgagagctgggaggcggcgctcacctgcgcctgcccgggccacgacaccggccagccgcgcgccaagcccgagtactgggtgctcatgctcaagtacttcatgtgcctggtggtgggcatcacgtcgggcgtctggatctggtcgggcaagacggtggagtcgtggcggcgtttcaccagccgctgctgctgccgcccgcggcgcggccacaagagcgggggcgccatggccgcaggggactaccccgaggcgagcgccgcgctcacaggcaggaccgggccgccgggccccgccgccacctaccacaagcaggtgtccctgtcgcacgtgtaggaggctgccgccgagggactcggccggagagctgaggggaggggggcgttttgtttggtagttttgccaaggtcacttccgtttaccttcatggtgctgttgccccctcccgcggcgacttggagagagggaagaggggcgttttcgaggaagaacctgtcccaggtcttctccaaggggcccagctcacgtgtattctattttgcgtttcttactgccttctttatgggaaccctctttttaatttatatgtatttttcttaatttgtaactttgttgcattttggcaacaatttacctttgctttgggggctttacaatcctaaggttggcgttgtaatgaagttccacttggttcaggtttctttgaactgtgtggtctcaattgggaaaatatatttcctatacgtgtgtctttaaaaaaaaatgtgaacagtgaacgtttcggttgctgtgactgggaagttgttgggtgtgctttttcagccagcttctccttccactgcttaaagtgtccatgattctttaaggtgagctgcagtttatagccccaggtcatacctaggaggggagcataatgagctcagggcctccccaaagtgacaaggttagggagtgcttagcggttttgtgttcagccttagctttgtttatagagggaggttcagtttcttttctgtagtgcttgtaataattctcactcctaacagcaccatcgttgtgtcttgaataagttagaggtagcattatagaggatctggcataaatatttgcagtagtgagagcctaagcgatggtgattggtggagcttgaattttaggctggtgagatggcagctttgtgcctgagaggtagtgggtggttcttaagcttcagtgatcccctttttttttttttttttttttttttaaggaacttgtgttataattttggtaaaagtataaacccactccctctggacaatacttagcgacagttgctaaagggggctcctttttaaatgtaaggactgaaatggatatacttctaataagtaaatttccaacacttatttgctccaccccctcccccctcccccctccccctttatcatgttaaacagcctttttgcttttcttattcctcctctcctggagagctgtgattagaaaccacacccacccttgaatgaagtgcttgaactgggggagggaggctggctacctgtgaacaaacattggcccaaataagggaaaataagtgttcctggactttggactagtttatagccagatattccaagagcagcaagacgttgctctctgccgtctctgaaaacaaaagagatgcataacatgcttgcacaaccttttaaaatatagatcagtatagtgctacctctatagttttcttcctcttctgagaaagcctgtatattgatgatcacacacacacacactttgcaattagagaatttggtttgctttactaatctgtttaactattccttcattcattatgaacgcttatattgatgaacatacacacagaggtttctttgctattagaaaattctgtttgctttcctaatctgtttaagcattcattcatgaagagtgtggggccattactggggaaggggggtgacagtgcctcagccagcaaaataccaatgaccaggattggggactaaatttaggaagctaaaatggccagagcaattaacatttgagaaaatcctgtctaggaaaacaacttgagtgtaggcatttgtaattcacttataccaaagttggaaaagtaaaatttaagcctaggacaatttttacttcatggatgttaaatagacaaatgcatagttcccagggggaatttaaacactttactggtgggaagaaacctagtattaaagttgtaaggactctcaaaaacttcacatttattaaaatgcactgctcttacccaatttatcctctgaattaaaatttcagtggattctacaaaacctcgtacaaatagctacagaactttgtgcctattttattcctctatttattcttctaggaagaagcctcttcctagaatcttgaaatagatcccttgactgaatgccaattcctctcctgtttttcaaatgagagaaccttttctgatcaccttgaccttttccctcatttcatatgtcttcccagaaagtagacagactgctctgctgccttcagtcattgtgcctcatttgggttgtccctccttctttgtggagaaatctggaaatgatgcacagtgtatccaaaagttgtgggatgaagtggatgaaagtgatttaattcatttttagaatttttttttgttttgttttagcaacatgctgaacaactaatttactttaaaaataagccagttaaaacaaaggacgctaagcccaagtggggggcaatattagtcaggatctttggggtctaattccagaccaactttcagaagcacttctttgtctctgttctcacctctgctgtccctctcttccctcatcccctaagagagacaaagataaaagcccacctgcatccctaagtcttactgagatcagccaccccaggggagagaaactggatctacttacagccaccccctgtttccatccatatagttacttcccccaatttgcatgtgattatggaaacaagtcatgctcatgaaagcaactgtaaaataaaaggttatggagtagttcagcaacttcttcacagccagctttgtggagctggggaggacttagggcccattggagtctcttatgtgtacagcttcagggctgtccctttcagtttgattttaagcaatgcctcacttcatagcttagggggtaaggattccattcaggtaggttgtctaaaggaactaatgggacctctcagtgaattagctgaccagattttaggaaatctttttaatttctatgattttccttctcacattttgaaatggtaaaattgactggaaataatttttcttggtgccttattggttttccttgcaaacctttctcatattttctcatgaccattgccagtgaccaaggcccatgtgtgtgttgtgtgtaattgtgggcatgtacaagcttaaataacgtgccgacagcactgtttcaaagttggtattcattaggctgttgcctcctgggctggagctgcgctaatcctgacaccggctgccaggagaaaacctcatggatcacacaccaaaccttaataacagcatccgtgacctgcactctccagtacagaatgggaaccccagagctaggaaatgtagttgtatattttaatgaactgctaccccagccaaagaagcttctttcacttttgtgctctacagaaagcccaaggggggtaggagggacagagctttgaataactgctttctaacactaaatgtggccaacaggacagagcacatcacacgtataggcaggtgtgagggacagtggctaagaattgcctgctccctctgcatgctctttcttgtttccaaagtccaatcaagtgatcctgggaaacaaatctgtctggattgcggagggtggttctgaaagaactgccaagacgttaaagaagggtgaagagtaggcagaatataagtagctaacctgagtcaagactctcaaaagctagcagcctgatgacaataggatttatttcagccaggatagtgtctgtctgtgagtgcatcattttaagacagtatgacttcatgttgttacaaactatgtatagtatgtatgttttgtgggttgtatatatacataatatatattatatatatatatgagagatttggtgacttttgatacgggtttggtgcaggtgaatttattactgagccaaatgaggcacataccgagtcagtagttgaagtccagggcattcgatactgtttatgatttccatatatgtatagtgcctatcccatgctgtagtcactgttatgttaaatccagaagttacactagagccagcgatactttatttgtagacaatcaatttgaatccatatgttattactggcagatgatacatgattacagttctgaatctgtaacacttacaaaaggaaacccagagcagcttgatgagtttttgtttctgcttcgttcctgggagtcagtagaaacagcagttgtatgtggttatgttagtctcaagatacttaatttgttgaccttacttcagaaaaattttgtatgtattatatttgtgggaaggtaaaataatcatttgagatttttatcaaatatgaagattagttatttatgaaaaacaaagaaatgtctatttttctttgttcccaattaatgtagataaattttaaaatgcattaaagtaatggtaaagacaataaaaagatgctgtagaa

SEQ ID NO: 2439 - DNA, 3958 bp, Homo sapiens
ggacggagccaaagaatgctccgcctgcgcgcgccgcttccgttgccatagtggccgggggcgggaggctggcgcctcccagcttctgtactccgcgaagcaaaacctagggagctgaggcctaggcgaggcgagagtcgccggcgtgcgtaacgttggcgcacgtgactccggcccggcctacagggcgcgtgcgcagtgggacttgagtgcctcctggtccctgtctgccggcattcgcggctgcggggcccggagttgctggtaggaggagttggcggaagcacttggaactcctttataagtgtcagctgtgagattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaacttaatgcatttcttgatttgaagaactccctaaatgaagtaaaaaacctactgagtgataagaaactggatgagtggcatgagcacactgctttcactaataaagcggggaaaatcatttctcatgttagaaaatctgtgaatgctgaactttgtactcaagcatggtgtaagttccatgagattttgtgcagctttccacttattccacaggaagcttttcagaatggaaaactgaattctctacacctttgtgaagctccaggagcttttatagctagtctcaaccactacttaaaatcccatcggtttccttgtcattggagttgggtagcgaatactctgaatccataccatgaagcaaatgacgacctcatgatgattatggatgaccggcttattgcaaataccttgcactggtggtactttggtccagataacactggtgatatcatgaccctgaaattcttgactggacttcagaatttcataagcagcatggctactgttcacttggtcactgcagatgggagttttgattgccaaggaaacccaggtgaacaagaagctttagtttcttctttgcattactgtgaagttgtcactgctctgaccactcttggaaacggtggctcttttgttctaaagatgtttactatgtttgaacattgttccataaacttgatgtacctgctaaactgttgttttgaccaagtccatgttttcaaacctgctactagcaaggcaggaaactccgaagtctatgtggtttgcctccactataaggggagagaggccatccatcctctgttatctaagatgaccttgaattttgggactgaaatgaaaaggaaagccctttttccccatcatgtgattcctgattcttttcttaagagacatgaagaatgttgtgtgttctttcataaatatcagctagagactatttctgaaaacattcgtctatttgagtgcatgggaaaggcggaacaagaaaagctgaataatttaagggattgtgctatacaatattttatgcaaaaatttcaactgaaacatctttccagaaataattggctagtaaaaaaatctagtattggttgtagtacaaatacaaaatggtttgggcagaggaacaaatattttaaaacttataatgaaaggaagatgctagaagccctttcatggaaagataaagtagccaaaggatactttaatagttgggctgaagaacatggtgtatatcatcctgggcagagttctattttagaaggaacagcttccaatcttgagtgtcacttatggcatattttggagggaaagaaactgccaaaggtaaaatgttctcctttttgcaatggtgaaattttaaaaactcttaatgaagcaattgaaaagtcattaggaggagcttttaatttggattccaagtttaggccaaaacagcagtattcttgttcttgtcatgttttttctgaagaactgatattttccgagttgtgtagccttactgagtgccttcaggatgagcaggttgtagtacccagcaatcaaataaagtgcctgctggtgggcttttcgactctccgtaatatcaaaatgcatataccgttggaagttcgactcctagaatcagctgaactcacaacttttagctgttcattgcttcatgatggagatccaacttaccagcgtttatttttggactgccttctacattcattgcgggagcttcatacaggagatgttatgattttgcctgtactttcttgcttcacaagatttatggctggtttgatctttgtactccacagttgttttagattcatcacttttgtttgtcccacatcctctgatcccctgaggacctgcgcagtcctgctatgtgttggttatcaggaccttccaaatccagttttccgatatttgcagagtgtgaatgaattgttgagcactttgctcaactctgactcaccccagcaggttttacagtttgtgccaatggaggtactccttaagggggccctgcttgattttttgtgggatttgaatgctgccattgctaaaaggcatttgcatttcattattcaaagagagagagaagaaattatcaacagccttcagttacaaaactgaacatatgctttctgagattcaactttatgatttcttataatttgcccagtatttgcatcctgttgctctattaatttaaaaaccttttattttggggaaaggccaacatttgcatcattcaaagtctcattaattctggaaaaccatccattctgatctctagggtatatacacccacaggcatagagctcttccacgtggtggaatctatgcaatgatagatattcacactctaaatatgaggtgtgtgtatgtgtatgggtggccacagccatgcttacctatgccatttagttggtcttacttaatctgcttaagatttgcatctgtgtacctttgttcagattagttttttttttccagccgatttcctcttagtggctaatgctgttagtgaattttccaactaatttcctctcattggttaatgttgttaatgaattgagagaggtaattgaggaaaggaaatgagtaaatcactgttcagcaacactgatttccgttaacacatcagttatgaatttcagggaattcatctcgccagattcttgataacatgccattcattgcccttaggtgattgaccctattttcttacatggctcaaataaaactagtatgctgttgtatgaatcttttactgaccacaccatccaactataaaaatataacgggacagctttaaaccaaagatcatgtttagaacaatgaaaaattatttgttgtatctaatacacgcctgtattgtgaaaagcttcatttagcaatgatgtaataatttttaacttccaggaaataatctgtgaatggaaagattttttaagattttgagatagtgtttagtctcatgttgggaacacatgaatgtgatgaacatagtgaatactaaagaaaacgcttcagactttcagaatgatggttcagaatttaaaatttttaatcttttctaatttctttttttcagtgtgaaaatagcactttaccaaaagattagccatgaaatggttattttgccagttacatttgatttcttttgtatctgcaatgtaatgagttattttatttcttctgtatttgcagtgtaatgagtttttgtggcaaagtgtattaagcaatttttcattatcttgaagttccacaaagtggagaatatttatattctcacatgcattttaggcacttttgatatgtgaaaatagatgtattttctgatgcatttggttaataaatattaatctgaacattttcatgttctttgctattttgaattccattatagattcatgaataaagtcattactagagaga

SEQ ID NO: 2440 - DNA, 4168 bp, Homo sapiens
cggagccaaagaatgctccgcctgcgcgcgccgcttccgttgccatagtggccgggggcgggaggctggcgcctcccagcttctgtactccgcgaagcaaaacctagggagctgaggcctaggcgaggcgagagtcgccggcgtgcgtaacgttggcgcacgtgactccggcccggcctacagggcgcgtgcgcagtgggacttgagtgcctcctggtccctgtctgccggcattcgcggctgcggggcccggaggtgggactggcttcccggtgccgcgagggcgggtccggacagccttccccccagtccggcgcaccatctccctgccttgtggctggaggcgccgcggacccaaagggagggaccatcccgggaagcagccccgagagcggaagtgcagaatggcttcctcgagagagtaaagtgcagcctctccagacactggggccccagtgggcgtgggcgaagttgctggtaggaggagttggcggaagcacttggaactcctttataagtgtcagctgtgagattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaacttaatgcatttcttgatttgaagaactccctaaatgaagtaaaaaacctactgagtgataagaaactggatgagtggcatgagcacactgctttcactaataaagcggggaaaatcatttctcatgttagaaaatctgtgaatgctgaactttgtactcaagcatggtgtaagttccatgagattttgtgcagctttccacttattccacaggaagcttttcagaatggaaaactgaattctctacacctttgtgaagctccaggagcttttatagctagtctcaaccactacttaaaatcccatcggtttccttgtcattggagttgggtagcgaatactctgaatccataccatgaagcaaatgacgacctcatgatgattatggatgaccggcttattgcaaataccttgcactggtggtactttggtccagataacactggtgatatcatgaccctgaaattcttgactggacttcagaatttcataagcagcatggctactgttcacttggtcactgcagatgggagttttgattgccaaggaaacccaggtgaacaagaagctttagtttcttctttgcattactgtgaagttgtcactgctctgaccactcttggaaacggtggctcttttgttctaaagatgtttactatgtttgaacattgttccataaacttgatgtacctgctaaactgttgttttgaccaagtccatgttttcaaacctgctactagcaaggcaggaaactccgaagtctatgtggtttgcctccactataaggggagagaggccatccatcctctgttatctaagatgaccttgaattttgggactgaaatgaaaaggaaagccctttttccccatcatgtgattcctgattcttttcttaagagacatgaagaatgttgtgtgttctttcataaatatcagctagagactatttctgaaaacattcgtctatttgagtgcatgggaaaggcggaacaagaaaagctgaataatttaagggattgtgctatacaatattttatgcaaaaatttcaactgaaacatctttccagaaataattggctagtaaaaaaatctagtattggttgtagtacaaatacaaaatggtttgggcagaggaacaaatattttaaaacttataatgaaaggaagatgctagaagccctttcatggaaagataaagtagccaaaggatactttaatagttgggctgaagaacatggtgtatatcatcctgggcagagttctattttagaaggaacagcttccaatcttgagtgtcacttatggcatattttggagggaaagaaactgccaaaggtaaaatgttctcctttttgcaatggtgaaattttaaaaactcttaatgaagcaattgaaaagtcattaggaggagcttttaatttggattccaagtttaggccaaaacagcagtattcttgttcttgtcatgttttttctgaagaactgatattttccgagttgtgtagccttactgagtgccttcaggatgagcaggttgtagtacccagcaatcaaataaagtgcctgctggtgggcttttcgactctccgtaatatcaaaatgcatataccgttggaagttcgactcctagaatcagctgaactcacaacttttagctgttcattgcttcatgatggagatccaacttaccagcgtttatttttggactgccttctacattcattgcgggagcttcatacaggagatgttatgattttgcctgtactttcttgcttcacaagatttatggctggtttgatctttgtactccacagttgttttagattcatcacttttgtttgtcccacatcctctgatcccctgaggacctgcgcagtcctgctatgtgttggttatcaggaccttccaaatccagttttccgatatttgcagagtgtgaatgaattgttgagcactttgctcaactctgactcaccccagcaggttttacagtttgtgccaatggaggtactccttaagggggccctgcttgattttttgtgggatttgaatgctgccattgctaaaaggcatttgcatttcattattcaaagagagagagaagaaattatcaacagccttcagttacaaaactgaacatatgctttctgagattcaactttatgatttcttataatttgcccagtatttgcatcctgttgctctattaatttaaaaaccttttattttggggaaaggccaacatttgcatcattcaaagtctcattaattctggaaaaccatccattctgatctctagggtatatacacccacaggcatagagctcttccacgtggtggaatctatgcaatgatagatattcacactctaaatatgaggtgtgtgtatgtgtatgggtggccacagccatgcttacctatgccatttagttggtcttacttaatctgcttaagatttgcatctgtgtacctttgttcagattagttttttttttccagccgatttcctcttagtggctaatgctgttagtgaattttccaactaatttcctctcattggttaatgttgttaatgaattgagagaggtaattgaggaaaggaaatgagtaaatcactgttcagcaacactgatttccgttaacacatcagttatgaatttcagggaattcatctcgccagattcttgataacatgccattcattgcccttaggtgattgaccctattttcttacatggctcaaataaaactagtatgctgttgtatgaatcttttactgaccacaccatccaactataaaaatataacgggacagctttaaaccaaagatcatgtttagaacaatgaaaaattatttgttgtatctaatacacgcctgtattgtgaaaagcttcatttagcaatgatgtaataatttttaacttccaggaaataatctgtgaatggaaagattttttaagattttgagatagtgtttagtctcatgttgggaacacatgaatgtgatgaacatagtgaatactaaagaaaacgcttcagactttcagaatgatggttcagaatttaaaatttttaatcttttctaatttctttttttcagtgtgaaaatagcactttaccaaaagattagccatgaaatggttattttgccagttacatttgatttcttttgtatctgcaatgtaatgagttattttatttcttctgtatttgcagtgtaatgagtttttgtggcaaagtgtattaagcaatttttcattatcttgaagttccacaaagtggagaatatttatattctcacatgcattttaggcacttttgatatgtgaaaatagatgtattttctgatgcatttggttaataaatattaatctgaacattttcatgttctttgctattttgaattccattatagattcatgaataaagtcattactagag

SEQ ID NO: 2441 - DNA, 3825 bp, Homo sapiens
gctccagtcctagtccagttggagaagcggagagtttcccctgtcttaaagaagagggcccccgcagccttcccgagaactttccatagggccgtggcctcaggcggactgcgaaccaagatcatcagcagggggcggcccggtgttcttagaacccgggtcccaagagcttgtgaacagggcacgagtgaaaacccggatccaggctggctccgccggaacgcgccccgagctcgcccgcgcggccgcctcttccgctcctgatcggctcttcgggtcttcccggcgcccaggcttgggctcatagggagaaaggaagctgcgctgcattctgcgggacgaaccctgctccgcgcgagaatttttttgattccttcttatttggagaaatctccagctgctctgatgatagcctaagaagactgcatgctgcttcctctcgatgccaagccagaccctctcacaacctcggatctcagtccttcatggagacctggtcccagcaggaatggcagtgcaggaaattggcgcccagatggttcttccatgtgaagttgtctcgggctctgggctgacgagagaacacctggtaaccaggttagccctctgtcagtcacccagggcagggcagcatggtgcggattcagaggaggaagcttttggcatcttgcctgtgcgtcacagccaccgtctttctgcttgtcacactccaggtcatggttgagctggggaagtttgaaaggaaggagtttaaaagttccagtttgcaagatggacatacaaaaatggaggaagcacctacgcatcttaattcatttcttaagaaagaaggattgaccttcaacaggaaaagaaaatgggaattggacagctaccccattatgctctggtggtccccgctgacgggggagactgggaggttaggccaatgtggagcagatgcttgtttcttcaccatcaaccggacctacctccatcatcacatgaccaaagcattcctcttctatggtactgactttaacatagatagcttacctctgcctcggaaagcccatcatgactgggctgtttttcatgaagagtccccgaaaaacaattataagctctttcataaaccagtgatcaccttgttcaactacactgccacgttcagcaggcattcccacttgccactaactacccaatacttggagagcattgaagtcctgaagtcactccgatacctagttcctttgcagtccaaaaacaagcttagaaaaagacttgctccgctggtgtatgtacagtcagactgtgacccaccatcagacagggacagctatgttcgcgagctgatgacttacatcgaggtcgattcctatggtgaatgtttacgaaacaaagacctccctcagcagctgaaaaatccagcctctatggatgccgatggcttttataggatcattgcacagtataagtttatcctagcttttgagaatgcagtttgtgatgactacatcactgagaagttctggaggccactgaaactgggggtagtccctgtatattacggatcccccagcatcacagactggcttccaagtaacaaaagtgctattcttgtatcagaattttctcaccccagggaactggcaagttacatcagacgactggattctgatgacagattgtatgaggcctatgtagaatggaagctgaagggtgagatctctaaccagcgacttctgacagctctcagggaacggaaatggggagtgcaagacgtcaaccaggacaattacatcgatgcatttgagtgtatggtgtgcaccaaggtgtgggctaatatcaggcttcaggaaaagggcttaccacccaaaagatgggaggcagaagatacccacctgagttgcccagagcccacagtgtttgctttctcaccactccggactccacctttgagctctttgcgagagatgtggatttccagctttgaacaatccaagaaagaagcccaggcactaaggtggctggttgataggaatcaaaacttttcatctcaagagttttggggcctagtattcaaggactgatttcaaaaatgatcagaatgaaacagactagagccttcttgaggtttattttctaggttgccttaatatttgaacataatagctattctgttgactatccatcaggataataattagttgctgcagtactcataatgagccctttcaaggaatagatgtaaattacccttaggggtagccactatattttttatactaaaaaaggaaatatttcttatggacactggttatcttccatgtccgtgtctgtggacccacatacttactgccttttgtggaaattcacctagagtgagtactttccttgtgcaatggagggagacgatctagctatagattcttgatactcacctcactctcaacagcttattggtatttggcaaacctggtatcctgcagccgagcatgaacatgaaatacattagaacttggcaatgagagatcccatctgttggtttccagggatgtaagtgagtaataaaagctgtttcaagtttatccactatccactcttcaagtgaaaagaacttatgtgtgtctaccttcttctccataccctgagccacctctctcactttctttagttgtgccttgccctatcgcctcccattttcccttcaaagtagaatgtcttgtaaagacacagtaactcctgtgtgttttgattagtgagatgttaccacttaccccttctgctgcgcagaataatattaagaattgctatgcttatgattcaggctggacagcctggacattttgagcagcgcgagagtagaagtgaatacccccaggaactccaattgtgctgaagctgatttgtctgttcgtaggatgatgtgcagcctgtcacagtggcagccacaggcattcagtttgtgggcatttcctgtcatttcggatcctgctatagggaaggttcagctctcctgtctggggcatctactggagcacctcagaagacaaggaggaaaacactggctcatgttttctttccatgtgagggaggggaggtttctagatgatactaaaagcctgttgccactgttgtgtcatgatttccattcttcatcatggaaagccacaagcctcagaaggcagccagaggacaggaagagtctgtgatgctcatgtctgtgtcatggcatgagggggaattgacgagtgcttgcttagcatcagctctcattgtattgaaggctgtgcccttggtgtgcttagcagtgagcagcgtcttcattaggtagctctggctgggctttgtcagccagcgtgtgagaaaggagaaccaaaaccaatacctccttatagaagccagaaggatcacattggatgagagaaggtgtctataactgggttcttcccaatcccagctctttcattaactaaatatgatcttggacatatctcttaacctccatcggccttagtttttgcatccaaaaagaagtgattgggctggtcttggaaggtttttttcttttttttcccctgtgtaacattcttcattgttcatcaacatttaagaaatttaattttgtagatgtttttactaaagagggtaacaaactattttggaactgctgtatgttattcaagggaagcacgctgtttggaggaaggagcatacttaatgggtagtattgaggatgaaagggaatttctctctctgccattttatttgataatattaaagaaataaagactggaaagggggattccttgttaaaggtcagattttaaattgcatataaaa

SEQ ID NO: 2442 - DNA, 1654 bp, Homo sapiens
gtcttcccggcgcccaggcttgggctcatagggagaaaggaagctgcgctgcattctgcgggacgaaccctgctccgcgcgagaatttttttgattccttcttatttggagaaatctccagctgctctgatgatagcctaagaagactgcatgctgcttcctctcgatgccaagccagaccctctcacaacctcggatctcagtccttcatggagacctggtcccagcaggaatggcagtgcaggaaattggcgcccagatggttcttccatgtgaagttgtctcgggctctgggctgacgagagaacacctggtaaccaggttagccctctgtcagtcacccagggcagggcagcatggtgcggattcagaggaggaagcttttggcatcttgcctgtgcgtcacagccaccgtctttctgcttgtcacactccaggtcatggttgagctggggaagtttgaaaggaaggagtttaaaagttccagtttgcaagatggacatacaaaaatggaggaagcacctacgcatcttaattcatttcttaagaaagaaggattgaccttcaacaggaaaagaaaatgggaattggacagctaccccattatgctctggtggtccccgctgacgggggagactgggaggttaggccaatgtggagcagatgcttgtttcttcaccatcaaccggacctacctccatcatcacatgaccaaagcattcctcttctatggtcccaagaagaatcaccacctttggcagaaaatgatggtactgactttaacatagatagcttacctctgcctcggaaagcccatcatgactgggctgtttttcatgaagagtccccgaaaaacaattataagctctttcataaaccagtgatcaccttgttcaactacactgccacgttcagcaggcattcccacttgccactaactacccaatacttggagagcattgaagtcctgaagtcactccgatacctagttcctttgcagtccaaaaacaagcttagaaaaagacttgctccgctggtgtatgtacagtcagactgtgacccaccatcagacagggacagctatgttcgcgagctgatgacttacatcgaggtcgattcctatggtgaatgtttacgaaacaaagacctccctcagcagctgaaaaatccagcctctatggatgccgatggcttttataggatcattgcacagtataagtttatcctagcttttgagaatgcagtttgtgatgactacatcactgagaagttctggaggccactgaaactgggggtagtccctgtatattacggatcccccagcatcacagactggcttccaagtaacaaaagtgctattcttgtatcagaattttctcaccccagggaactggcaagttacatcagacgactggattctgatgacagattgtatgaggcctatgtagaatggaagctgaagggtgagatctctaaccagcgacttctgacagctctcagggaacggaaatggggagtgcaagacgtcaaccaggacaattacatcgatgcatttgagtgtatggtgtgcaccaaggtgtgggctaatatcaggcttcaggaaaaggtaagcaaatcaaaggtgggcatagagccagcaggctggccatcttga

SEQ ID NO: 2443 - DNA, 3675 bp, Homo sapiens
gtcttcccggcgcccaggcttgggctcatagggagaaaggaagctgcgctgcattctgcgggacgaaccctgctccgcgcgagaatttttttgattccttcttatttggagaaatctccagctgctctgatgatagcctaagaagactgcatgctgcttcctctcgatgccaagccagaccctctcacaacctcggatctcagtccttcatggagacctggtcccagcaggaatggcagtgcaggaaattggcgcccagatggttcttccatgtgaagttgtctcgggctctgggctgacgagagaacacctggtaaccaggttagccctctgtcagtcacccagggcagggcagcatggtgcggattcagaggaggaagcttttggcatcttgcctgtgcgtcacagccaccgtctttctgcttgtcacactccaggccttggataccgttgagaatctaatgaaagtcacgggccctccccagggagttacagactccatgcaatgcttcaatgatcagcggcctttatctaacaccaggagcagcgagcacataaaagaggtcatggttgagctggggaagtttgaaaggaaggagtttaaaagttccagtttgcaagatggacatacaaaaatggaggaagcacctacgcatcttaattcatttcttaagaaagaaggattgaccttcaacaggaaaagaaaatgggaattggacagctaccccattatgctctggtggtccccgctgacgggggagactgggaggttaggccaatgtggagcagatgcttgtttcttcaccatcaaccggacctacctccatcatcacatgaccaaagcattcctcttctatggtactgactttaacatagatagcttacctctgcctcggaaagcccatcatgactgggctgtttttcatgaagagtccccgaaaaacaattataagctctttcataaaccagtgatcaccttgttcaactacactgccacgttcagcaggcattcccacttgccactaactacccaatacttggagagcattgaagtcctgaagtcactccgatacctagttcctttgcagtccaaaaacaagcttagaaaaagacttgctccgctggtgtatgtacagtcagactgtgacccaccatcagacagggacagctatgttcgcgagctgatgacttacatcgaggtcgattcctatggtgaatgtttacgaaacaaagacctccctcagcagctgaaaaatccagcctctatggatgccgatggcttttataggatcattgcacagtataagtttatcctagcttttgagaatgcagtttgtgatgactacatcactgagaagttctggaggccactgaaactgggggtagtccctgtatattacggatcccccagcatcacagactggcttccaagtaacaaaagtgctattcttgtatcagaattttctcaccccagggaactggcaagttacatcagacgactggattctgatgacagattgtatgaggcctatgtagaatggaagctgaagggtgagatctctaaccagcgacttctgacagctctcagggaacggaaatggggagtgcaagacgtcaaccaggacaattacatcgatgcatttgagtgtatggtgtgcaccaaggtgtgggctaatatcaggcttcaggaaaagggcttaccacccaaaagatgggaggcagaagatacccacctgagttgcccagagcccacagtgtttgctttctcaccactccggactccacctttgagctctttgcgagagatgtggatttccagctttgaacaatccaagaaagaagcccaggcactaaggtggctggttgataggaatcaaaacttttcatctcaagagttttggggcctagtattcaaggactgatttcaaaaatgatcagaatgaaacagactagagccttcttgaggtttattttctaggttgccttaatatttgaacataatagctattctgttgactatccatcaggataataattagttgctgcagtactcataatgagccctttcaaggaatagatgtaaattacccttaggggtagccactatattttttatactaaaaaaggaaatatttcttatggacactggttatcttccatgtccgtgtctgtggacccacatacttactgccttttgtggaaattcacctagagtgagtactttccttgtgcaatggagggagacgatctagctatagattcttgatactcacctcactctcaacagcttattggtatttggcaaacctggtatcctgcagccgagcatgaacatgaaatacattagaacttggcaatgagagatcccatctgttggtttccagggatgtaagtgagtaataaaagctgtttcaagtttatccactatccactcttcaagtgaaaagaacttatgtgtgtctaccttcttctccataccctgagccacctctctcactttctttagttgtgccttgccctatcgcctcccattttcccttcaaagtagaatgtcttgtaaagacacagtaactcctgtgtgttttgattagtgagatgttaccacttaccccttctgctgcgcagaataatattaagaattgctatgcttatgattcaggctggacagcctggacattttgagcagcgcgagagtagaagtgaatacccccaggaactccaattgtgctgaagctgatttgtctgttcgtaggatgatgtgcagcctgtcacagtggcagccacaggcattcagtttgtgggcatttcctgtcatttcggatcctgctatagggaaggttcagctctcctgtctggggcatctactggagcacctcagaagacaaggaggaaaacactggctcatgttttctttccatgtgagggaggggaggtttctagatgatactaaaagcctgttgccactgttgtgtcatgatttccattcttcatcatggaaagccacaagcctcagaaggcagccagaggacaggaagagtctgtgatgctcatgtctgtgtcatggcatgagggggaattgacgagtgcttgcttagcatcagctctcattgtattgaaggctgtgcccttggtgtgcttagcagtgagcagcgtcttcattaggtagctctggctgggctttgtcagccagcgtgtgagaaaggagaaccaaaaccaatacctccttatagaagccagaaggatcacattggatgagagaaggtgtctataactgggttcttcccaatcccagctctttcattaactaaatatgatcttggacatatctcttaacctccatcggccttagtttttgcatccaaaaagaagtgattgggctggtcttggaaggtttttttcttttttttcccctgtgtaacattcttcattgttcatcaacatttaagaaatttaattttgtagatgtttttactaaagagggtaacaaactattttggaactgctgtatgttattcaagggaagcacgctgtttggaggaaggagcatacttaatgggtagtattgaggatgaaagggaatttctctctctgccattttatttgataatattaaagaaataaagactggaaagggggattccttgttaaaggtcagattttaaattgcatataaaa

SEQ ID NO: 2444 - DNA, 2056 bp, Homo sapiens
ggggtcggtgctggccgagggggcgccggctgccggagtggacatggcggccggccccattagggtggtgttggtccttctaggggtgctcagtgtctgtgcagccagcggccatgggtccgtagcggagagggaggccggcggggaggcggagtgggcggaaccgtgggatggcgcggttttccggccgccctcggcgctgggcgcagtgggggtgacgcgcagctctgggacgccgcggccagggagggaggaggcgggggacttgccggtactgctgtggtggagcccagggctattcccccacttcccgggagactcggagcgcatcgagtgtgcgcgcggcgcgtgcgtggcgtcccggaaccgccgagcgctgagggactcgcggacgcgcgcgctgctcttctacggcacagacttccgcgcgtcggccgccccgctgccgcgcctggcgcaccagagctgggcgctcctccacgaggagtcgcccctcaacaacttcttgctgagccacggcccgggcatccgcctcttcaatcttacctccaccttcagtcgccactcggattacccgctgtcgctgcagtggctgcccgggaccgcctatctgcgccgcccggtgcctccgcccatggaacgcgcggagtggcgccgccgcggctacgcgccgctgctctatctgcagtcacactgcgacgtgccagcggaccgggaccgctacgtgcgcgagctcatgcgccacatcccggtagactcctacgggaaatgcctgcagaatcgggagctgcctaccgcgcggctacaggacacagccacggccaccaccgaggatccagagctcttggctttcttgtcccgctataagttccacttggccctggaaaatgccatctgtaacgactacatgacagaaaaactgtggcgtcccatgcacctgggcgctgtgcccgtgtaccgcggttctccctctgtgagggactggatgccgaacaatcactccgtcatcctgattgatgattttgagtctcctcagaagctggcagagtttattgactttctggacaagaatgatgaggagtatatgaaatacctggcatacaagcaacctgggggcatcaccaaccaatttcttctggatagtctgaagcatcgggagtggggagtgaatgatcctttgctgcctaactacctcaacggcttcgagtgtttcgtctgtgactacgaactggctcggctggatgccgagaaagcccacgcggcctctcccggggacagccccgtctttgagccccacattgcccagccctcacacatggactgcccagtgcccacacctggctttggcaatgtggaagagattcctgagaatgacagttggaaagagatgtggctgcaagattattggcaaggtctggaccagggggaagctctcactgccatgatccacaacaatgaaacagagcagacgaaattttgggattacctacatgaaatcttcatgaagaggcaacatctctaagtgcccttgcaagagcctttaacttggcggagctaaggagatcttattctaccatgggacataaggagcatccactgcacaaacccttaatgaacactgtcttttcatggattcaaggaattccagttttatctattaagattttatcttaatgatgagtagccaaggtctaacatagggcctctcctcaaggagagatggagggatacaattcttggttcagtgggaaacagaaccctaaaacatccatttgattcaaggtgctggtccaacagagtttttaaactactcacttctttatttcatcctttcgactgtacttgattaccagtgaagtaagatgggtcaggttacgacttacaacttttgttctattccccagactcctcattattcagtacatttcccaataatctctttttctcatctcttgctttataaattgttacgttggtggagaagcaaaacatttggtgagttgtattctggttttccggagttggatttttttatattatatactttcatgtcaaa

SEQ ID NO: 2445 - DNA, 1474 bp, Homo sapiens
ggggtcggtgctggccgagggggcgccggctgccggagtggacatggcggccggccccattagggtggtgttggtccttctaggggtgctcagtgtctgtgcagccagcggccatgggtccgtagcggagagggaggccggcggggaggcggagtgggcggaaccgtgggatggcgcggttttccggccgccctcggcgctgggcgcagtgggggtgacgcgcagctctgggacgccgcggccagggagggaggaggcgggggacttgccggtactgctgtggtggagcccagggctattcccccacttcccgggagactcggagcgcatcgagtgtgcgcgcggcgcgtgcgtggcgtcccggaaccgccgagcgctgagggactcgcggacgcgcgcgctgctcttctacggcacagacttccgcgcgtcggccgccccgctgccgcgcctggcgcaccagagctgggcgctcctccacgaggagtcgcccctcaacaacttcttgctgagccacggcccgggcatccgcctcttcaatcttacctccaccttcagtcgccactcggattacccgctgtcgctgcagtggctgcccgggaccgcctatctgcgccgcccggtgcctccgcccatggaacgcgcggagtggcgccgccgcggctacgcgccgctgctctatctgcagtcacactgcgacgtgccagcggaccgggaccgctacgtgcgcgagctcatgcgccacatcccggtagactcctacgggaaatgcctgcagaatcgggagctgcctaccgcgcggctacaggacacagccacggccaccaccgaggatccagagctcttggctttcttgtcccgctataagttccacttggccctggaaaatgccatctgtaacgactacatgacagaaaaactgtggcgtcccatgcacctgggcgctgtgcccgtgtaccgcggttctccctctgtgagggactggatgccgaacaatcactccgtcatcctgattgatgattttgagtctcctcagaagctggcagagtttattgactttctggacaagaatgatgaggagtatatgaaatacctggcatacaagcaacctgggggcatcaccaaccaatttcttctggatagtctgaagcatcgggagtggggagtgaatgatcctttgctgcctaactacctcaacggcttcgagtgtttcgtctgtgactacgaactggctcggctggatgccgagaaagcccacgcggcctctcccggggacagccccgtctttgagccccacattgcccagccctcacacatggactgcccagtgcccacacctggctttggcaatgtggaagagattcctgagaatgacagcagtcttgtccaagttagagaccactgtatctgcttaagatttctttggccccactcggaaaaaggcaggactcataactatgctgcagttccataa

SEQ ID NO: 2446 - DNA, 6455 bp, Homo sapiens
tgagcgagcgagccccgacggccgcggtgggtggaggggggaaagtgggggagagtggggcgggagtagagggagagcgagggagggagcctcacccccgggacgctttctgcgcacgcgcatctcggtgcatctgttgggcgggaccgcggggcctgtgacaccgcacgctgagctctgtgatgtagccgcttgcggagactgcaagcagccgcggcgcgcccggccctccctcttccgctgccgccgtgggaatggaaacatctgccccacgtgccggaagccaagtggtggcgacaactgcgcgccactccgcggcctaccgcgcagatcctctacgtgtgtcctcgcgagacaagctcaccgaaatggccgcgtccagtcaaggaaactttgagggaaattttgagtcactggaccttgcggaatttgctaagaagcagccatggtggcgtaagctgttcgggcaggaatctggaccttcagcagaaaagtatagcgtggcaacccagctgttcattggaggtgtcactggatggtgcacaggtttcatattccagaaggttggaaagttggctgcaacagctgtgggaggtggattttttctccttcagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaagattttggtatcttggtgtctactttcttttttagttggttttacattacagaaagctatttaaatgtgttataattatgccgacaaaattggcagcataattactgtaattgaaaaatctgatattgtccaggaatgctttctaccgtacaggataatgtatctcatggctgtttccaaagggtttatttattgtaaaacaagtgatttaggtgggaaagggaagattttggatttttattttgtagaaaaggttttaagctttgaaatgtgaatgaaatatccttatcaaaacattaggggtggccataactcctctgtgccacttctactatttttttttttaatctagttagtatgaaatacaacatttaaaccggaattttaaagaagtagctttccagggattcagaattaagaaagatagtgataggacatgagaaataaatttccatcaagtgtaatctaccgtctcatgatgaccacaaccctgagaattattctttaaaagcttacacacacacacacacacgggcacacacgcacacacagaatcttaccacattttgctgtagtggcatgttaccatgtctacagtccctactagaatatcagtcagctttcagagggcaagacttctgtcttcaccattatactcacagggcctagcacttaataggtgctgagtatttgaataatgactttatagaaagaaaactcactattaaaggttagttttactcagaattgttaatcttggagatgatctcttgtgaaatatgagtgtgtttctaaggccatacatttaaaaatgtttgcattttaacccgtcttgagaatgatgtattgaatttgaaaatcaaaactaccagtggatgtgtggaactttacagaaaccacctatttgcgtttttctccttacatttaaggaaacataagccattttgcttgcaatatgtatgaatcatctcaaaaccataatggtatgagcctctttgctgcatattttgctataagaacttattttttttcactttttattatggacgctttcaggaatatataaaagtagagaatatagtacaataatccccctgtgtatctatcactcactcacaacaatcatcaaattatagctctgctggtttttaccagttattgtgaaacaaatatcaaaatgtcattttatcatatttcagtatgtatctctaaaaggtaagaattatttctaaaaatcataaatacctcatcatatcagacattaacagtaattacataatatccaaaatctgatcagtgttcaaaatttcctcaagtgttttatatttagtttgtttgaatcaaaattcatgcaaggttcacatcgtatttgcatgatttggataagtctcttaaccttatagatcctcctctatttttttttttttgcttgctatatatttatatctctatatatattgatatagacatatgtagtgacactgagtcatctgtttcctgcttccccacactctgcctctcctgacatctgggtctctgggttatgccatatatggtgatagtggctgcagccactttacctgtgtgacttacccacagcaatgggatggtaacagcaaagctaaccaaagtgctctgtgcccctttgggttgcatgtggggagactggccacccaatgcctctccagtggggtaggggttgtcttttggtgcatctgtttttcctgtgattattggtgagggcagcaaagattagcaggtggttgtaaactaccttgagtaggttgtaataaatagtctggcctcagactgtattctgattgtctgaattaagatctgtaggtaggtccctcctgaagttttttcccagctggctgcctctacgactgtgagggtcatggttgaggtcagtattgcaggttggcctcatcctgctagtatgagaacggctgtgagttctgcccacggtgtgaggccactgtgaccacttgggattgtgcagagctggcatggaggttgaacacgcacagctgcacaccttgttttcagtttagctgaaccatcggtgaaggaggctcaggcatttggggttacctgtgaatcaaggccctattgtgccagcagttttgtttcaggtggtgaagtgggagttaaggtttcccccaaaagaacagctgccactcctccatgcaaaaccgagatgattcaaggaccaggcagctccacctttcagtgcactactttcatttgactggagaggcctgcttagctaggcacgtattttctccagtagcagagtccaatgacgctctggacttcctaattagtggtggtggggcggaagtttttccttgggaagagcgttgtcgctgtatatggtccgcagaaacttgacttggaatgtgttcggggtttcatcgcccccttgtggcggcgacgtggtaacaccgcactcaaggcttccaacttgtcaaccaataggatggcatctacgtagtgaaggcttcccttcccttgtcctgcagcgtgctggacagtgtcccggctcagggaccccttctgtccccttcctggctactatgggtcggccctgcgtcctcaccactttgagccaccctttgacccagcgtctctcccgcaatgggacctggtgggatggggacttggagcatgctacaggagaggtagaacttttgagtctcttcttcccaaggttctccccagagtcggagagcagagacggatccaggggcactttctggccgctgcctgctcgggctcaacagatggagtccaatgtttcagtctcccccaagaatgtgtatcctcattgctgacacgggagctgggtgcggggagagatgtggtggtggggacccttgcctgagcagcccattgtcatgagtgttattgccattgtgataatatgttagcatgactctcctcccaaatggccgcttgtttgttgcaatctcccgccactcagcctccagacattcattaacaggacagtggggttcttgactcccctaccactggggtgacagtccttgctactggatctgggcagttactgtctcatggatgctggcagaagacgattcaagttggcggactagattctacaaggaatgatctcttgcataattctagccaacatgctcttggggtgggtgcttctggttttggaaagcaaagttactgtgtagttaacaactattgtggtaagaatagtctctccatcattcttttgtttcacggttgtcagaaagatgggcataactaatggttgggctcttatttggaacctctacttttgtacagtttgggaatctctgcttgaaaagatggtatactgatggatttgaaatttctgagtatcatcaatgtttcatgatgatctcaatttcttctcagagggaagctcacagccagttttggaccccagagaaaaatgtggctgctgccctctactccctctaccaaattatcagcttcatttctttgtcatgaaatctagtatgatttctcagaaatcaggcccagaactaaaatacattttctgcccaattttctaagaggtcacactaacatctgagtaattgggcagaaaacctattttagttctgagcctgatttttctagaagtcatatggtatagcttatatttccgatgcttgcattctttttaaggggtcatgaatcttaatacttttttttttaaaagaaaagtgtcgcactttttcacatttttataaagctttaaagtcagtttactgacttttcaaaagtgtctacctttttaaattttaaaatggtaagaaatgacattcctgagagcagtggctttcatccttgcttgcacttgggaatcacctgtgaaattttaaaaactactaatgcctggctctcatcctagagattctgatttcactggtctggagtgctgttcaggcatcctgaggttttaaagtgtcttagctttttctaatgagcagcagagactgagaaccactgaagtacacagttggaagctggtgctgaaaaaattaagagttttgctgttaactccttaagagggctttaaagccttttatattaagtgccatacaacttcagatgccttctgaatactgaacacaagtgtaatattatagttcattaaatgtcttaggaatcgtgtggagtgaatgcaaggaaaggagtgacaagatatcaccccacaaatgacttacccattacgaagggaaaactacctttctagctaaaaggtctgtcagtcactaaccaagtgattaaacttagcatcactaatagccaacttaacaaagtttttttttttttttggtttctaaaatgggagatcatagttttcaccttcctagagttctttgcttaagactgagattcagtgttactcttggtccctaacaataagaagcactcagtaaatgttaagccttctatgatggctattttatttttttgtatgtcataataatacctaagaataagaagagttaaattaatgtcttcaaatggatttgttgacttaaactgacacaatcctttaaaagaaggaactgatttgaacctttcaaaactgaaagaaagtcgtatactgatacagtttggagccaccgaatgtcatgttgaaccgtattccctaatggaggtggatcctggtgagaggtgattggatcgtgggggccatcccctcttggtacttcactcatgatagtgagttctcatgagatctggcacttcacccctcactctctcttgctcctgctttggccatgtggagtgctcactccccttttgctttctgccatggctgtaagtttcctgaggcgtccccagaagcccatcagataccagtgccatgcttcctgtacagcccatggaactgtgagccaactaaacctcttttatttataaattaccgagtctcaggcactttttatagcaatgcaacaatggactaatacatatactttagcataaaaacatttaaaagagtctgaaactggagtagttaactcagtaaaaataacttggcaataaaacacagaaaaacaatctatttgatcatgtagtgattcctaatgtaaatcctagtacaactgtcaactgataattttaaatgtaatttagatttgtagatggtgtaacattaaagttgtatgatgtt

SEQ ID NO: 2447 - DNA, 10005 bp, Homo sapiens
atggcattgacagagacacaaccacagctcctttcagcagacctggtcttagccctccaggtgctcatgctttgggagatgacagaggcaaacaaagtacttaagagaagacaacacccccaacgatctcactgtatttccagcaaaatacttgagtcctacccaggtgaaaagccattgacaaaatctctgcaacgtggagaagacccccaatttgatcaggtcatcagctcaatgagctccctttctgagtactgcctgccttccattctacgtacattatttgactgcgatgaacaacagcgagattatttaatggaaagacgggacctcgccattgattttattttttctttagtattaatagaagttttgaaacagggatccctaacttgtctaattataccctacttaggtaccttggtcccaacactggcaatatgcatattgtggcagacctgtatgcagaagtcattggagtgttggcacaagccaagtaaattccctgctgtaaagaagaaatttatggcggagctaaaagaattacggcacaaagagcagaacccatatgtggttcaaagcattatcagcttaataatgggcatgaaattctttcgaattaagatgtatccagtggaggattttgaggcctctcttcagtttatgcaggaatgtgcacattacttcctcgaggtcaaagacaaagatatcaagcatgccttggctgggctttttgttgaaatacttgttccagttgctgctgctgttaaaaatgaagtaaatgttccctgccttagaaattttgtggaaagcctgtatgacaccacgctggaactttcttctcgaaagaagcattccttggccttgtaccccctggtgacctgtttgctctgtgtcagtcagaagcagctgttcctgaacaggtggcacattttcctcaacaactgcttgtccaaccttaaaaacaaagatcccaagatggctcgagttgcactggaatctctctacagattactttgggtttacatgattcgaattaaatgtgaaagcaacacagctactcagagccgacttataaccatcatcacaacacttttccccaaagggtcccgcggtgtggtaccaagggacatgcctctgaacatctttgtgaaaatcatccagttcattgcccaggaacgtttagattttgcaatgaaagaaatcattttcgattttctttgtgtgggaaaaccagcaaaagcattcagtctcaacccagagagaatgaacattggtttacgggcattcttggtcatagctgatagcttgcagcagaaagatggggaacctcccatgccggttacaggagccgttcttccttcaggaaacacgttaagagtaaagaaaacatatttgagtaaaacactaactgaagaggaagccaaaatgataggcatgtccttatattactctcaagtacgaaaagctgtagacaacattttaaggcaccttgataaagaagtaggaaggtgtatgatgctgactaatgtacagatgttaaacaaagaaccggaagacatgatcacgggtgagagaaagccaaaaatagatcttttcaggacctgtgttgctgctattcctcgactgcttcctgatgggatgtcaaaacttgaacttattgacttactggctaggctctctattcatatggatgatgaattgcgacatattgcacaaaattctcttcagggtttacttgttgacttctcagattggagggaagatgtactatttggctttaccaacttcctgctccgggaagtaaatgatatgcatcacacactccttgattcgtccctgaagttgctgctgcagctgctcacccagtggaaactagtcatccagacacaaggaaaagtctatgaacaagccaacaaaatcagaaattcagagctcatcgcaaatggctccagtcacagaattcagtcggaacgaggtccccactgcagtgtactccacgctgtagaaggttttgctctggttttactctgcagtttccaggtggccacacgcaaactgtccgttttaatactcaaggaaattcgagcgttgtttattgccctggggcagcctgaggatgacgacaggccgatgattgatgtcatggatcagctaagttcttccattctagaaagttttattcatgtagcagtttcggattcagcaacattaccactcacccacaatgtggatctgcagtggttggtggaatggaacgcagtcctggtcaatagccattatgatgtgaaaagcccttcccatgtctggatatttgcacagtctgtcaaagacccctgggtcctctgcctcttcagcttcctccggcaggagaacttacccaagcactgccccacagccctcagctatgcctggccttatgccttcactcggctccagtcggtgatgcctctggtggacccaaatagcccaattaatgccaagaaaaccagcactgccggcagcggagacaactatgttactttgtggagaaattacctaattctttgttttggagttgcaaaacccagtattatgagcccaggacacttaagagcttccactccagaaataatggcgaccacacctgatggtacagtgagctacgataacaaggccataggcaccccatcggtgggagttctgttaaagcagttggtgcctttgatgagactagagagcattgagatcacagagtccttagttttaggatttggaagaacaaattcccttgttttcagagaattggtagaagaacttcatccattaatgaaagaagctctggaaagaagaccagagaacaagaaacgccgagaacggcgagacttgttaaggctacaactacttcgaatttttgaacttttggctgatgctggtgtaataagtgacagcacaaatggagccctagagcgggatactttagccctgggagctttgttcttagaatatgtggacttgacccgcatgctcctagaagctgaaaatgacaaagaagttgaaattcttaaagatatccgggcacattttagtgcaatggtggccaacttgattcagtgtgttccagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagcaatgtcagcagtactgtgctgtggccctgtctttgacaatgtgggcctttccccagatggctacctatataaatggcttgacaacattctggcttgtcaagatttacgagttcatcaacttggctgcgaagttgttgtcttgctactggaacttaatcctgaccaaataaatctttttaactgggcaattgaccgatgctacacaggttcctaccaacttgcatctggctgcttcaaagccatagcaactgtgtgtggaagcaggaactatcccttcgacatagtgacattgttaaaccttgttctattcaaggcctctgacaccaacagagagatttatgaaatctccatgcagctcatgcagatccttgaagcaaagctttttgtatactcaaagaaagtcgctgagcaaagaccgggaagtattctctatggaacacacggcccgctgccacccctctacagcgtgtcacttgccctcttgtcatgtgagctggccaggatgtaccctgagctcacactccccctcttctcagaggtaagccagcgattccccacaacacaccccaacgggcgccagatcatgcttacctacctgctgccctggctgcacaacatcgagctggtggacagcaggctcctcctcccggggtcgagccccagcagcccagaggacgaagtcaaggaccgggaaggtgacgtgactgcttctcacgggctgagaggaaatggctggggctctccagaagccacgtcactggtcctgaacaacctcatgtacatgacggccaagtatggagatgaagttcctgggccagaaatggaaaatgcttggaatgctttagccaacaatgagaaatggagcaacaacctgaggatcaccttgcagttcctgattagcctctgtggggtcagcagcgacacagttctcctaccctatattaaaaaagtggcaatatacttgtgccgtaacaacaccattcaaaccatggaagagcttctctttgagctgcagcagacagagcccgtgaaccccatcgtccagcattgtgacaacccgcccttctaccgcttcacggccagtagcaaggcttccgcagcagcctcaggaaccacctctagcagcaatacagtggttgctggccaggaaaatttcccagatgctgaggagaacaagatattgaaagaatctgatgaaaggtttagtaatgtcatcagagcccacactcgcctcgagtcaagatacagcaatagctctggaggatcctacgatgaagataaaaatgatccaatttctccctacacgggctggttgctgactattacagagaccaagcagccgcagcccttaccgatgccttgtactggaggatgctgggcccccctggttgactatctcccggagaccatcactccccgggggccactccacaggtgcaatattgctgtaatttttatgactgaaatggtggtggatcacagtgtacgagaagactgggcgcttcatctaccattattacttcatgctgtcttcttaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccagggcatttggtccactttggtgccatgaagacatcacacctaaaaatcaaaattcaaagagtgctgaacagctcactaattttctacgtcacgttgtatctgtatttaaagattccaaatcaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcagggttatgtaatggaagcgctcctaaccttggaggcggctgtggataacttgtctgactgcttgaagaacagtgacctcctaactgtattgtcccgctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattgggtttccactgaatgtcttgtgtctcctgcctcagctgattcagcattttgaaaatcccaatcagttctgtaaggatatagccgaaaggattgctcaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaaagtgttcactggagagaagctctgaatatcttgaagctggtagtttctcggtcagccagccttgttttaccttcataccagcacagtgacctctcaaaaatagaaatacatcgagtgtggactagtgcttccaaggaattacctgggaaaaccctggacttccacttcgatatttcggagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcagaagagaacaaaagagaagttggtacatgtcctttctctgtgtggccaagaagtaggattgagcaaaaatccatcagtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaagcaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagactaaaaaaaaaaaaaaagacaaaataca

SEQ ID NO: 2448 - DNA, 650 bp, Homo sapiens
catgcttgctgtgtagcaaatggaatctcttgcacaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctg

SEQ ID NO: 2449 - DNA, 8848 bp, Homo sapiens
agggggcggcgctcccggcccatcccttagccccgcggcggccgtgtgggccggaggctgcctgcaccgcgtcagggaggccggcctagaaaccctccctcccagaagaaagccgatcccagttcaggtggggtcttcctcggttgcgtacctggctggagccgagctggtgggcggccggcagccggcgtttctggtgatgacagccccgaaatgaaagcagcgcggccgccgcctccgagggctgcagggagatcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatacttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggaaaagccattgacaaaatctctgcaacgtggagaagacccccaatttgatcaggtcatcagctcaatgagctccctttctgagtactgcctgccttccattctacgtacattatttgactggtataaaaggcaaaatggcattgaggatgaatcacatgaatacagaccaagaacaagcaataaatcaaaaagcgatgaacaacagcgagattatttaatggaaagacgggacctcgccattgattttattttttctttagtattaatagaagttttgaaacagattccacttcatcctgtaatagacagtttaatacatgatgttattaacttggctttcaagcactttaaatacaaagaagggtaccttggtcccaacactggcaatatgcatattgtggcagacctgtatgcagaagtcattggagtgttggcacaagccaaattccctgctgtaaagaagaaatttatggcggagctaaaagaattacggcacaaagagcagaacccatatgtggttcaaagcattatcagcttaataatgggcatgaaattctttcgaattaagatgtatccagtggaggattttgaggcctctcttcagtttatgcaggaatgtgcacattacttcctcgaggtcaaagacaaagatatcaagcatgccttggctgggctttttgttgaaatacttgttccagttgctgctgctgttaaaaatgaagtaaatgttccctgccttagaaattttgtggaaagcctgtatgacaccacgctggaactttcttctcgaaagaagcattccttggccttgtaccccctggtgacctgtttgctctgtgtcagtcagaagcagctgttcctgaacaggtggcacattttcctcaacaactgcttgtccaaccttaaaaacaaagatcccaagatggctcgagttgcactggaatctctctacagattactttgggtttacatgattcgaattaaatgtgaaagcaacacagctactcagagccgacttataaccatcatcacaacacttttccccaaagggtcccgcggtgtggtaccaagggacatgcctctgaacatctttgtgaaaatcatccagttcattgcccaggaacgtttagattttgcaatgaaagaaatcattttcgattttctttgtgtgggaaaaccagcaaaagcattcagtctcaacccagagagaatgaacattggtttacgggcattcttggtcatagctgatagcttgcagcagaaagatggggaacctcccatgccggttacaggagccgttcttccttcaggaaacacgttaagagtaaagaaaacatatttgagtaaaacactaactgaagaggaagccaaaatgataggcatgtccttatattactctcaagtacgaaaagctgtagacaacattttaaggcaccttgataaagaagtaggaaggtgtatgatgctgactaatgtacagatgttaaacaaagaaccggaagacatgatcacgggtgagagaaagccaaaaatagatcttttcaggacctgtgttgctgctattcctcgactgcttcctgatgggatgtcaaaacttgaacttattgacttactggctaggctctctattcatatggatgatgaattgcgacatattgcacaaaattctcttcagggtttacttgttgacttctcagattggagggaagatgtactatttggctttaccaacttcctgctccgggaagtaaatgatatgcatcacacactccttgattcgtccctgaagttgctgctgcagctgctcacccagtggaaactagtcatccagacacaaggaaaagtctatgaacaagccaacaaaatcagaaattcagagctcatcgcaaatggctccagtcacagaattcagtcggaacgaggtccccactgcagtgtactccacgctgtagaaggttttgctctggttttactctgcagtttccaggtggccacacgcaaactgtccgttttaatactcaaggaaattcgagcgttgtttattgccctggggcagcctgaggatgacgacaggccgatgattgatgtcatggatcagctaagttcttccattctagaaagttttattcatgtagcagtttcggattcagcaacattaccactcacccacaatgtggatctgcagtggttggtggaatggaacgcagtcctggtcaatagccattatgatgtgaaaagcccttcccatgtctggatatttgcacagtctgtcaaagacccctgggtcctctgcctcttcagcttcctccggcaggagaacttacccaagcactgccccacagccctcagctatgcctggccttatgccttcactcggctccagtcggtgatgcctctggtggacccaaatagcccaattaatgccaagaaaaccagcactgccggcagcggagacaactatgttactttgtggagaaattacctaattctttgttttggagttgcaaaacccagtattatgagcccaggacacttaagagcttccactccagaaataatggcgaccacacctgatggtacagtgagctacgataacaaggccataggcaccccatcggtgggagttctgttaaagcagttggtgcctttgatgagactagagagcattgagatcacagagtccttagttttaggatttggaagaacaaattcccttgttttcagagaattggtagaagaacttcatccattaatgaaagaagctctggaaagaagaccagagaacaagaaacgccgagaacggcgagacttgttaaggctacaactacttcgaatttttgaacttttggctgatgctggtgtaataagtgacagcacaaatggagccctagagcgggatactttagccctgggagctttgttcttagaatatgtggacttgacccgcatgctcctagaagctgaaaatgacaaagaagttgaaattcttaaagatatccgggcacattttagtgcaatggtggccaacttgattcagtgtgttccagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagcaatgtcagcagtactgtgctgtggccctgtctttgacaatgtgggcctttccccagatggctacctatataaatggcttgacaacattctggcttgtcaagatttacgagttcatcaacttggctgcgaagttgttgtcttgctactggaacttaatcctgaccaaataaatctttttaactgggcaattgaccgatgctacacaggttcctaccaacttgcatctggctgcttcaaagccatagcaactgtgtgtggaagcaggaactatcccttcgacatagtgacattgttaaaccttgttctattcaaggcctctgacaccaacagagagatttatgaaatctccatgcagctcatgcagatccttgaagcaaagctttttgtatactcaaagaaagtcgctgagcaaagaccgggaagtattctctatggaacacacggcccgctgccacccctctacagcgtgtcacttgccctcttgtcatgtgagctggccaggatgtaccctgagctcacactccccctcttctcagaggtaagccagcgattccccacaacacaccccaacgggcgccagatcatgcttacctacctgctgccctggctgcacaacatcgagctggtggacagcaggctcctcctcccggggtcgagccccagcagcccagaggacgaagtcaaggaccgggaaggtgacgtgactgcttctcacgggctgagaggaaatggctggggctctccagaagccacgtcactggtcctgaacaacctcatgtacatgacggccaagtatggagatgaagttcctgggccagaaatggaaaatgcttggaatgctttagccaacaatgagaaatggagcaacaacctgaggatcaccttgcagttcctgattagcctctgtggggtcagcagcgacacagttctcctaccctatattaaaaaagtggcaatatacttgtgccgtaacaacaccattcaaaccatggaagagcttctctttgagctgcagcagacagagcccgtgaaccccatcgtccagcattgtgacaacccgcccttctaccgcttcacggccagtagcaaggcttccgcagcagcctcaggaaccacctctagcagcaatacagtggttgctggccaggaaaatttcccagatgctgaggagaacaagatattgaaagaatctgatgaaaggtttagtaatgtcatcagagcccacactcgcctcgagtcaagatacagcaatagctctggaggatcctacgatgaagataaaaatgatccaatttctccctacacgggctggttgctgactattacagagaccaagcagccgcagcccttaccgatgccttgtactggaggatgctgggcccccctggttgactatctcccggagaccatcactccccgggggccactccacaggtgcaatattgctgtaatttttatgactgaaatggtggtggatcacagtgtacgagaagactgggcgcttcatctaccattattacttcatgctgtcttcttaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccagggcatttggtccactttggtgccatgaagacatcacacctaaaaatcaaaattcaaagagtgctgaacagctcactaattttctacgtcacgttgtatctgtatttaaagattccaaatcaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcagggttatgtaatggaagcgctcctaaccttggaggcggctgtggataacttgtctgactgcttgaagaacagtgacctcctaactgtattgtcccgctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattgggtttccactgaatgtcttgtgtctcctgcctcagctgattcagcattttgaaaatcccaatcagttctgtaaggatatagccgaaaggattgctcaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaaagtgttcactggagagaagctctgaatatcttgaagctggtagtttctcggtcagccagccttgttttaccttcataccagcacagtgacctctcaaaaatagaaatacatcgagtgtggactagtgcttccaaggaattacctgggaaaaccctggacttccacttcgatatttcggagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcagaagagaacaaaagagaagttggtacatgtcctttctctgtgtggccaagaagtaggattgagcaaaaatccatcagtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggcctaagaggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgccgagctcaagttcagtgtgttagaactgcaagaatatttggatacctacaacaacaggaaagaggccacactctctgtaagctt

SEQ ID NO: 2450 - DNA, 10735 bp, Homo sapiens
agggggcggcgctcccggcccatcccttagccccgcggcggccgtgtgggccggaggctgcctgcaccgcgtcagggaggccggcctagaaaccctccctcccagaagaaagccgatcccagttcaggtggggtcttcctcggttgcgtacctggctggagccgagctggtgggcggccggcagccggcgtttctggtgatgacagccccgaaatgaaagcagcgcggccgccgcctccgagggctgcagggagatcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatacttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggaaaagccattgacaaaatctctgcaacgtggagaagacccccaatttgatcaggtcatcagctcaatgagctccctttctgagtactgcctgccttccattctacgtacattatttgactggtataaaaggcaaaatggcattgaggatgaatcacatgaatacagaccaagaacaagcaataaatcaaaaagcgatgaacaacagcgagattatttaatggaaagacgggacctcgccattgattttattttttctttagtattaatagaagttttgaaacagattccacttcatcctgtaatagacagtttaatacatgatgttattaacttggctttcaagcactttaaatacaaagaagggtaccttggtcccaacactggcaatatgcatattgtggcagacctgtatgcagaagtcattggagtgttggcacaagccaaattccctgctgtaaagaagaaatttatggcggagctaaaagaattacggcacaaagagcagaacccatatgtggttcaaagcattatcagcttaataatgggcatgaaattctttcgaattaagatgtatccagtggaggattttgaggcctctcttcagtttatgcaggaatgtgcacattacttcctcgaggtcaaagacaaagatatcaagcatgccttggctgggctttttgttgaaatacttgttccagttgctgctgctgttaaaaatgaagtaaatgttccctgccttagaaattttgtggaaagcctgtatgacaccacgctggaactttcttctcgaaagaagcattccttggccttgtaccccctggtgacctgtttgctctgtgtcagtcagaagcagctgttcctgaacaggtggcacattttcctcaacaactgcttgtccaaccttaaaaacaaagatcccaagatggctcgagttgcactggaatctctctacagattactttgggtttacatgattcgaattaaatgtgaaagcaacacagctactcagagccgacttataaccatcatcacaacacttttccccaaagggtcccgcggtgtggtaccaagggacatgcctctgaacatctttgtgaaaatcatccagttcattgcccaggaacgtttagattttgcaatgaaagaaatcattttcgattttctttgtgtgggaaaaccagcaaaagcattcagtctcaacccagagagaatgaacattggtttacgggcattcttggtcatagctgatagcttgcagcagaaagatggggaacctcccatgccggttacaggagccgttcttccttcaggaaacacgttaagagtaaagaaaacatatttgagtaaaacactaactgaagaggaagccaaaatgataggcatgtccttatattactctcaagtacgaaaagctgtagacaacattttaaggcaccttgataaagaagtaggaaggtgtatgatgctgactaatgtacagatgttaaacaaagaaccggaagacatgatcacgggtgagagaaagccaaaaatagatcttttcaggacctgtgttgctgctattcctcgactgcttcctgatgggatgtcaaaacttgaacttattgacttactggctaggctctctattcatatggatgatgaattgcgacatattgcacaaaattctcttcagggtttacttgttgacttctcagattggagggaagatgtactatttggctttaccaacttcctgctccgggaagtaaatgatatgcatcacacactccttgattcgtccctgaagttgctgctgcagctgctcacccagtggaaactagtcatccagacacaaggaaaagtctatgaacaagccaacaaaatcagaaattcagagctcatcgcaaatggctccagtcacagaattcagtcggaacgaggtccccactgcagtgtactccacgctgtagaaggttttgctctggttttactctgcagtttccaggtggccacacgcaaactgtccgttttaatactcaaggaaattcgagcgttgtttattgccctggggcagcctgaggatgacgacaggccgatgattgatgtcatggatcagctaagttcttccattctagaaagttttattcatgtagcagtttcggattcagcaacattaccactcacccacaatgtggatctgcagtggttggtggaatggaacgcagtcctggtcaatagccattatgatgtgaaaagcccttcccatgtctggatatttgcacagtctgtcaaagacccctgggtcctctgcctcttcagcttcctccggcaggagaacttacccaagcactgccccacagccctcagctatgcctggccttatgccttcactcggctccagtcggtgatgcctctggtggacccaaatagcccaattaatgccaagaaaaccagcactgccggcagcggagacaactatgttactttgtggagaaattacctaattctttgttttggagttgcaaaacccagtattatgagcccaggacacttaagagcttccactccagaaataatggcgaccacacctgatggtacagtgagctacgataacaaggccataggcaccccatcggtgggagttctgttaaagcagttggtgcctttgatgagactagagagcattgagatcacagagtccttagttttaggatttggaagaacaaattcccttgttttcagagaattggtagaagaacttcatccattaatgaaagaagctctggaaagaagaccagagaacaagaaacgccgagaacggcgagacttgttaaggctacaactacttcgaatttttgaacttttggctgatgctggtgtaataagtgacagcacaaatggagccctagagcgggatactttagccctgggagctttgttcttagaatatgtggacttgacccgcatgctcctagaagctgaaaatgacaaagaagttgaaattcttaaagatatccgggcacattttagtgcaatggtggccaacttgattcagtgtgttccagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagcaatgtcagcagtactgtgctgtggccctgtctttgacaatgtgggcctttccccagatggctacctatataaatggcttgacaacattctggcttgtcaagatttacgagttcatcaacttggctgcgaagttgttgtcttgctactggaacttaatcctgaccaaataaatctttttaactgggcaattgaccgatgctacacaggttcctaccaacttgcatctggctgcttcaaagccatagcaactgtgtgtggaagcaggaactatcccttcgacatagtgacattgttaaaccttgttctattcaaggcctctgacaccaacagagagatttatgaaatctccatgcagctcatgcagatccttgaagcaaagctttttgtatactcaaagaaagtcgctgagcaaagaccgggaagtattctctatggaacacacggcccgctgccacccctctacagcgtgtcacttgccctcttgtcatgtgagctggccaggatgtaccctgagctcacactccccctcttctcagaggtaagccagcgattccccacaacacaccccaacgggcgccagatcatgcttacctacctgctgccctggctgcacaacatcgagctggtggacagcaggctcctcctcccggggtcgagccccagcagcccagaggacgaagtcaaggaccgggaaggtgacgtgactgcttctcacgggctgagaggaaatggctggggctctccagaagccacgtcactggtcctgaacaacctcatgtacatgacggccaagtatggagatgaagttcctgggccagaaatggaaaatgcttggaatgctttagccaacaatgagaaatggagcaacaacctgaggatcaccttgcagttcctgattagcctctgtggggtcagcagcgacacagttctcctaccctatattaaaaaagtggcaatatacttgtgccgtaacaacaccattcaaaccatggaagagcttctctttgagctgcagcagacagagcccgtgaaccccatcgtccagcattgtgacaacccgcccttctaccgcttcacggccagtagcaaggcttccgcagcagcctcaggaaccacctctagcagcaatacagtggttgctggccaggaaaatttcccagatgctgaggagaacaagatattgaaagaatctgatgaaaggtttagtaatgtcatcagagcccacactcgcctcgagtcaagatacagcaatagctctggaggatcctacgatgaagataaaaatgatccaatttctccctacacgggctggttgctgactattacagagaccaagcagccgcagcccttaccgatgccttgtactggaggatgctgggcccccctggttgactatctcccggagaccatcactccccgggggccactccacaggtgcaatattgctgtaatttttatgactgaaatggtggtggatcacagtgtacgagaagactgggcgcttcatctaccattattacttcatgctgtcttcttaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccagggcatttggtccactttggtgccatgaagacatcacacctaaaaatcaaaattcaaagagtgctgaacagctcactaattttctacgtcacgttgtatctgtatttaaagattccaaatcaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcagggttatgtaatggaagcgctcctaaccttggaggcggctgtggataacttgtctgactgcttgaagaacagtgacctcctaactgtattgtcccgctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattgggtttccactgaatgtcttgtgtctcctgcctcagctgattcagcattttgaaaatcccaatcagttctgtaaggatatagccgaaaggattgctcaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaaagtgttcactggagagaagctctgaatatcttgaagctggtagtttctcggtcagccagccttgttttaccttcataccagcacagtgacctctcaaaaatagaaatacatcgagtgtggactagtgcttccaaggaattacctgggaaaaccctggacttccacttcgatatttcggagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcagaagagaacaaaagagaagttggtacatgtcctttctctgtgtggccaagaagtaggattgagcaaaaatccatcagtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaagcaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagactaaaaaaaaaaaaaaagacaaaatacacgttgaccatggacttta

SEQ ID NO: 2451 - DNA, 10630 bp, Homo sapiens
agggggcggcgctcccggcccatcccttagccccgcggcggccgtgtgggccggaggctgcctgcaccgcgtcagggaggccggcctagaaaccctccctcccagaagaaagccgatcccagttcaggtggggtcttcctcggttgcgtacctggctggagccgagctggtgggcggccggcagccggcgtttctggtgatgacagccccgaaatgaaagcagcgcggccgccgcctccgagggctgcagggagatcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatacttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggaaaagccattgacaaaatctctgcaacgtggagaagacccccaatttgatcaggtcatcagctcaatgagctccctttctgagtactgcctgccttccattctacgtacattatttgactggtataaaaggcaaaatggcattgaggatgaatcacatgaatacagaccaagaacaagcaataaatcaaaaagcgatgaacaacagcgagattatttaatggaaagacgggacctcgccattgattttattttttctttagtattaatagaagttttgaaacagattccacttcatcctgtaatagacagtttaatacatgatgttattaacttggctttcaagcactttaaatacaaagaagggtaccttggtcccaacactggcaatatgcatattgtggcagacctgtatgcagaagtcattggagtgttggcacaagccaaattccctgctgtaaagaagaaatttatggcggagctaaaagaattacggcacaaagagcagaacccatatgtggttcaaagcattatcagcttaataatgggcatgaaattctttcgaattaagatgtatccagtggaggattttgaggcctctcttcagtttatgcaggaatgtgcacattacttcctcgaggtcaaagacaaagatatcaagcatgccttggctgggctttttgttgaaatacttgttccagttgctgctgctgttaaaaatgaagtaaatgttccctgccttagaaattttgtggaaagcctgtatgacaccacgctggaactttcttctcgaaagaagcattccttggccttgtaccccctggtgacctgtttgctctgtgtcagtcagaagcagctgttcctgaacaggtggcacattttcctcaacaactgcttgtccaaccttaaaaacaaagatcccaagatggctcgagttgcactggaatctctctacagattactttgggtttacatgattcgaattaaatgtgaaagcaacacagctactcagagccgacttataaccatcatcacaacacttttccccaaagggtcccgcggtgtggtaccaagggacatgcctctgaacatctttgtgaaaatcatccagttcattgcccaggaacgtttagattttgcaatgaaagaaatcattttcgattttctttgtgtgggaaaaccagcaaaagcattcagtctcaacccagagagaatgaacattggtttacgggcattcttggtcatagctgatagcttgcagcagaaagatggggaacctcccatgccggttacaggagccgttcttccttcaggaaacacgttaagagtaaagaaaacatatttgagtaaaacactaactgaagaggaagccaaaatgataggcatgtccttatattactctcaagtacgaaaagctgtagacaacattttaaggcaccttgataaagaagtaggaaggtgtatgatgctgactaatgtacagatgttaaacaaagaaccggaagacatgatcacgggtgagagaaagccaaaaatagatcttttcaggacctgtgttgctgctattcctcgactgcttcctgatgggatgtcaaaacttgaacttattgacttactggctaggctctctattcatatggatgatgaattgcgacatattgcacaaaattctcttcagggtttacttgttgacttctcagattggagggaagatgtactatttggctttaccaacttcctgctccgggaagtaaatgatatgcatcacacactccttgattcgtccctgaagttgctgctgcagctgctcacccagtggaaactagtcatccagacacaaggaaaagtctatgaacaagccaacaaaatcagaaattcagagctcatcgcaaatggctccagtcacagaattcagtcggaacgaggtccccactgcagtgtactccacgctgtagaaggttttgctctggttttactctgcagtttccaggtggccacacgcaaactgtccgttttaatactcaaggaaattcgagcgttgtttattgccctggggcagcctgaggatgacgacaggccgatgattgatgtcatggatcagctaagttcttccattctagaaagttttattcatgtagcagtttcggattcagcaacattaccactcacccacaatgtggatctgcagtggttggtggaatggaacgcagtcctggtcaatagccattatgatgtgaaaagcccttcccatgtctggatatttgcacagtctgtcaaagacccctgggtcctctgcctcttcagcttcctccggcaggagaacttacccaagcactgccccacagccctcagctatgcctggccttatgccttcactcggctccagtcggtgatgcctctggtggacccaaatagcccaattaatgccaagaaaaccagcactgccggcagcggagacaactatgttactttgtggagaaattacctaattctttgttttggagttgcaaaacccagtattatgagcccaggacacttaagagcttccactccagaaataatggcgaccacacctgatggtacagtgagctacgataacaaggccataggcaccccatcggtgggagttctgttaaagcagttggtgcctttgatgagactagagagcattgagatcacagagtccttagttttaggatttggaagaacaaattcccttgttttcagagaattggtagaagaacttcatccattaatgaaagaagctctggaaagaagaccagagaacaagaaacgccgagaacggcgagacttgttaaggctacaactacttcgaatttttgaacttttggctgatgctggtgtaataagtgacagcacaaatggagccctagagcgggatactttagccctgggagctttgttcttagaatatgtggacttgacccgcatgctcctagaagctgaaaatgacaaagaagttgaaattcttaaagatatccgggcacattttagtgcaatggtggccaacttgattcagtgtgttccagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagcaatgtcagcagtactgtgctgtggccctgtctttgacaatgtgggcctttccccagatggctacctatataaatggcttgacaacattctggcttgtcaagatttacgagttcatcaacttggctgcgaagttgttgtcttgctactggaacttaatcctgaccaaataaatctttttaactgggcaattgaccgatgctacacaggttcctaccaacttgcatctggctgcttcaaagccatagcaactgtgtgtggaagcaggaactatcccttcgacatagtgacattgttaaaccttgttctattcaaggcctctgacaccaacagagagatttatgaaatctccatgcagctcatgcagatccttgaagcaaagctttttgtatactcaaagaaagtcgctgagcaaagaccgggaagtattctctatggaacacacggcccgctgccacccctctacagcgtgtcacttgccctcttgtcatgtgagctggccaggatgtaccctgagctcacactccccctcttctcaggtaagccagcgattccccacaacacaccccaacgggcgccagatcatgcttacctacctgctgccctggctgcacaacatcgagctggtggacagcaggctcctcctcccgggagccccagcagcccagaggacgaagtcaaggaccgggaaggtgacgtgactgcttctcacgggctgagaggaaatggctggggctctccagaagccacgtcactggtcctgaacaacctcatgtacatgacggccaagtatggagatgaagttcctgggccagaaatggaaaatgcttggaatgctttagccaacaatgagaaatggagcaacaacctgaggatcaccttgcagttcctgattagcctctgtggggtcagcagcgacacagttctcctaccctatattaaaaaagtggcaatatacttgtgccgtaacaacaccattcaaaccatggaagagcttctctttgagctgcagcagacagagcccgtgaaccccatcgtccagcattgtgacaacccgcccttctaccgcttcacggccagtagcaaggcttccgcagcagcctcaggaaccacctctagcagcaatacagtggttgctggccaggaaaatttcccagatgctgaggagaacaagatattgaaagaatctgatgaaaggtttagtaatgtcatcagagcccacactcgcctcgagtcaagatacagcaatagctctggaggatcctacgatgaagataaaaatgatccaatttctccctacacgggctggttgctgactattacagagaccaagcagccgcagcccttaccgatgccttgtactggaggatgctgggcccccctggttgactatctcccggagaccatcactccccgggggccactccacaggtgcaatattgctgtaatttttatgactgaaatggtggtggatcacagtgtacgagaagactgggcgcttcatctaccattattacttcatgctgtcttcttaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccagggcatttggtccactttggtgccatgaagacatcacacctaaaaatcaaaattcaaagagtgctgaacagctcactaattttctacgtcacgttgtatctgtatttaaagattccaaatcaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcagggttatgtaatggaagcgctcctaaccttggaggcggctgtggataacttgtctgactgcttgaagaacagtgacctcctaactgtattgtcccgctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattgggtttccactgaatgtcttgtgtctcctgcctcagctgattcagcattttgaaaatcccaatcagttctgtaaggatatagccgaaaggattgctcaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaacacagtgacctctcaaaaatagaaatacatcgagtgtggactagtgcttccaaggaattacctgggaaaaccctggacttccacttcgatatttcggagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcagaagagaacaaaagagaagttggtacatgtcctttctctgtgtggccaagaagtaggattgagcaaaaatccatcagtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaagcaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagactaaaaaaaaaaaaaaagacaaaataca

SEQ ID NO: 2452 - DNA, 691 bp, Homo sapiens
tggtatgaacagtctgccctggacggaaggcctgttttagtttgtcttctactgtaggtctttagcacctgactaaaaatacacctggggccaaaaatataagggccctgcattgtggctgagacacttatggtggcagtgagcaacaggaccatggagcccatcattatgtgttttggctttggaacatggtctgtgtagctgttccagactgttagtttgggtttcttttcaggctcatggagattacaactgcttgttggagacgatcctgtgtgatcagcttcataaaagggcttgcttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggaaaagccattgacaaaatctctgcaacgtggagaagacccccaatttgatcaggtcatcagctcaatgagctccctttctgagtactgcctgccttccattctacgtacattatttgactggtataaaaggcaaaatggcattgaggatgaatcacatgaatacagaccaagaacaagcaataaatcaaa

SEQ ID NO: 2453 - DNA, 1517 bp, Homo sapiens
ctctcactgatcctggttctgcctgccctagagccctttcattgtcctgctcattccacattttgtagtcaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaagcaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaa

SEQ ID NO: 2454 - DNA, 635 bp, Homo sapiens
agatccgttctctgcgctgccagctcaggtgagccctcgccaaggtgacctcgcaggacactggtgaaggagcagtgaggaacctgcagagtcacacagttggctgaccaattgagctgtgagcctggagcagatccgtgggctgcagacccccgccccagtgcctctccccctgcagccctgcccctcgaactgtgacatggagagagtgaccctggcccttctcctactggcaggcctgactgccttggaagccaatgacccatttgccaataaagacgatcccttctactatgactggaaaaacctgcagctgagcggactgatctgcggagggctcctggccattgctgggatcgcggcagttctgagtggcaaatgcaaatgcaagagcagccagaagcagcacagtcctgtacctgagaaggccatcccactcatcactccaggctctgccactacttgctgagcacaggactggcctccagggatggcctgaagcctaacactggcccccagcacctcctcccctgggaggccttatcctcaaggaaggacttctctccaagggcaggctgttaggcccctttctgatcaggaggcttctttatgaattaaactcgccccaccacccc

SEQ ID NO: 2455 - DNA, 771 bp, Homo sapiens
agatccgttctctgcgctgccagctcaggtgagccctcgccaaggtgacctcgcaggacactggtgaaggagcagtgaggaacctgcagagtcacacagttggccaccaccatctctagatgggaagacagaaagtagttactttcccaagatctccccacaagcaagtgtatccttggggtttgtacacctactttcaccatggggctctgcctgcccccgcccctgcctcctctcgctgaccaattgagctgtgagcctggagcagatccgtgggctgcagacccccgccccagtgcctctccccctgcagccctgcccctcgaactgtgacatggagagagtgaccctggcccttctcctactggcaggcctgactgccttggaagccaatgacccatttgccaataaagacgatcccttctactatgactggaaaaacctgcagctgagcggactgatctgcggagggctcctggccattgctgggatcgcggcagttctgagtggcaaatgcaaatgcaagagcagccagaagcagcacagtcctgtacctgagaaggccatcccactcatcactccaggctctgccactacttgctgagcacaggactggcctccagggatggcctgaagcctaacactggcccccagcacctcctcccctgggaggccttatcctcaaggaaggacttctctccaagggcaggctgttaggcccctttctgatcaggaggcttctttatgaattaaactcgccccaccaccccc

SEQ ID NO: 2456 - DNA, 3249 bp, Homo sapiens
ctccttaccatggtgacggccgcagagccgccaggagcagccgctggagtgcgaaaacgctctcaattttcgggtctcaaagacccacaagcccacaccacgcaggccgggacaggaaagagtcaccctttaaaacggccgagtgaagagcaagaaccacgcagcggttccgagcctctgttttccgcttttagctaggaggacggaagttgctggcaggcggcatttggccggtacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctgcagtggtataaggatgacttatgtgcattggcatttaaagttctccatgacaagcagcgaggaccactggtttttatgcgcatttactcaggcactataaaaccccagttggccattcataatattaatggaaactgcacggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccagatttggaacatgcgttgaaatgtcttcagcgtgaagatcccagtttgaaagtgaggctagatcctgactctggacaaactgttctgtgtggtatgggggagttacatatagagattattcatgatcgaatcaagagggaatatggactggagacctatctcgggcctctccaggtggcatatcgagagaccatcctaaactcagttcgtgccacagataccttagatagaactttaggagacaaaaggcatcttgtgactgtagaagtggaagcaaggccaattgaaacatcatctgttatgcctgtgattgagtttgagtatgctgaaagtatcaatgaaggccttttgaaggtctcccaagaggccattgaaaatggaattcacagcgcatgtctccaaggaccattgcttggatccccaattcaggatgtagcaattactttacattccctgacaattcatcctggcacctccacaactatgatttctgcctgtgtctcaagatgcgtgcaaaaggctctgaagaaagctgataagcaagttttggagcctctgatgaatcttgaggttacagtagctagagattatctcagccctgtcctggcagatctggcacaaagaagaggaaacattcaggaaattcagactcgccaggacaacaaagttgttattggatttgttcccttagcagaaattatgggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaacagtctaatatcttattttacatgatttcaaaataaagttgattgtagtacaga

SEQ ID NO: 2457 - DNA, 2856 bp, Homo sapiens
tggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccagatttggaacatgcgttgaaatgtcttcagcgtgaagatcccagtttgaaagtgaggctagatcctgactctggacaaactgttctgtgtggtatgggggagttacatatagagattattcatgatcgaatcaagagggaatatggactggagacctatctcgggcctctccaggtggcatatcgagagaccatcctaaactcagttcgtgccacagataccttagatagaactttaggagacaaaaggcatcttgtgactgtagaagtggaagcaaggccaattgaaacatcatctgttatgcctgtgattgagtttgagtatgctgaaagtatcaatgaaggccttttgaaggtctcccaagaggccattgaaaatggaattcacagcgcatgtctccaaggaccattgcttggatccccaattcaggatgtagcaattactttacattccctgacaattcatcctggcacctccacaactatgatttctgcctgtgtctcaagatgcgtgcaaaaggctctgaagaaagctgataagcaagttttggagcctctgatgaatcttgaggttacagtagctagagattatctcagccctgtcctggcagatctggcacaaagaagaggaaacattcaggaaattcagactcgccaggacaacaaagttgttattggatttgttcccttagcagaaattatgggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaacagtctaatatcttattttacatgatttcaaaataaagttgattgtagtaca

SEQ ID NO: 2458 - DNA, 1870 bp, Homo sapiens
tttggccggtacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctgcagtggtataaggatgacttatgtgcattggcatttaaagttctccatgacaagcagcgaggaccactggtttttatgcgcatttactcaggcactataaaaccccagttggccattcataatattaatggaaactgcacggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccaggtataaatggtcttagtgtgtcaactaattagtgcgctgataatttatataaaatagttgcaatataccctcaagagatttcttatgtgattgaggtaaattttatctgaatatattggtaaacatt

SEQ ID NO: 2459 - DNA, 3047 bp, Homo sapiens
cgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagtcacaactgtggagagactatgaggccctgaactttggcgttaccaatgaaaagggaatggattcaaggccaggcatggtggctcacgcctgtaatcccagcactttgggaggccgagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctgcagtggtataaggatgacttatgtgcattggcatttaaagttctccatgacaagcagcgaggaccactggtttttatgcgcatttactcaggcactataaaaccccagttggccattcataatattaatggaaactgcacggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccagatttggaacatgcgttgaaatgtcttcagcgtgaagatcccagtttgaaagtgaggctagatcctgactctggacaaactgttctgtgtggtatgggggagttacatatagagattattcatgatcgaatcaagagggaatatggactggagacctatctcgggcctctccaggtggcatatcgagagaccatcctaaactcagttcgtgccacagataccttagatagaactttaggagacaaaaggcatcttgtgactgtagaagtggaagcaaggccaattgaaacatcatctgttatgcctgtgattgagtttgagtatgctgaaagtatcaatgaaggccttttgaaggtctcccaagaggccattgaaaatggaattcacagcgcatgtctccaaggaccattgcttggatccccaattcaggatgtagcaattactttacattccctgacaattcatcctggcacctccacaactatgatttctgcctgtgtctcaagatgcgtgcaaaaggctctgaagaaagctgataagcaagttttggagcctctgatgaatcttgaggttacagtagctagagattatctcagccctgtcctggcagatctggcacaaagaagaggaaacattcaggaaattcagactcgccaggacaacaaagttgttattggatttgttcccttagcagaaattatgggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaa

SEQ ID NO: 2460 - DNA, 2556 bp, Homo sapiens
aaccacgcagcggttccgagcctctgttttccgcttttagctaggaggacggaagttgctggcaggcggcatttggccggtacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctgcagtggtataaggatgacttatgtgcattggcatttaaagttctccatgacaagcagcgaggaccactggtttttatgcgcatttactcaggcactataaaaccccagttggccattcataatattaatggaaactgcacggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccagatttggaacatgcgttgaaatgtcttcagcgtgaagatcccagtttgaaagtgaggctagatcctgactctggacaagtagcacaaagaagaggaaacattcaggaaattcagactcgccaggacaacaaagttgttattggatttgttcccttagcagaaattatgggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaacagtctaatatcttattttacatgatttcaaaataaagttgattgtagt

SEQ ID NO: 2461 - DNA, 1511 bp, Homo sapiens
cgacacttgacccagaccagtcccaacgcccagtgcggccgcccggggagccgcgggagaggcggcggcggggggaggagggagaggagggccgagccggcggcacgggaggcccggttttgaagccgcttctctgcccgagttaggtttcgcccagcgcaatttctttctctatgtactttgcgaataagtttcggagcatcggttaacagcctatgggtgaaatttggctttcattcatgaatgagaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaaaaagagagaaaagaagaaaaaagaaggaacagcaacagagtgaagcaaatgagctcaggaatcttgcttttaagaaaattccccagaaatcctcccatgctgtttgtaacgctcaacatgatcttccattgtcaaacccagtacagaaggattcacgagaagaaaattggcaagagtggagacaaagagatgagcagctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactgaggaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttcttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttcca

SEQ ID NO: 2462 - DNA, 1778 bp, Homo sapiens
tgcagccgcgctcacctccgcggtccgccccggcgccccgggacccgttagtgcccagcctgtgggccgaccgcgacccccgcccggcgcgagcctgcccccagctctgccgacacttgacccagaccagtcccaacgcccagtgcggccgcccggggagccgcgggagaggcggcggcggggggaggagggagaggagggccgagccggcggcacgggaggcccggttttgaagccgcttctctgcccgagttaggtttcgcccagcgcaatttctttctctatgtactttgcgaataagtttcggagcatcggttaacagcctatgggtgaaatttggctttcattcatgaatgagaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaaaaagagagaaaagaagaaaaaagaaggaacagcaacagagtgaagcaaatgagctcaggaatcttgcttttaagaaaattccccagaaatcctcccatgctgtttgtaacgctcaacatgatcttccattgtcaaacccagtacagaaggattcacgagaagaaaattggcaagagtggagacaaagagatgagcagctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactgaggaattgagttcttctcagactttatcacatgatggaggattcttcaatagactggaagatgatgttcataaaattcttattagagaaaaacgaagagaacagcttacagaatataatggaacagataattgtacagctcatgaacacaaccaggaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttcttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccactaa

SEQ ID NO: 2463 - DNA, 1231 bp, Homo sapiens
agaaaagaagaatactaacatacagttttcctgagttaccttaagtgagttgaaaactaaaagccctatccctcaaggaacttacagtccagtgacattacttatggagagagtaaagcaggcctgcagccgcgctcacctccgcggtccgccccggcgccccgggacccgttagtgcccagcctgtgggccgaccgcgacccccgcccggcgcgagcctgcccccagctctgccgacacttgacccagaccagtcccaacgcccagtgcggccgcccggggagccgcgggagaggcggcggcggggggaggagggagaggagggccgagccggcggcacgggaggcccggttttgaagccgcttctctgcccgagttaggtttcgcccagcgcaatttctttctctatgtactttgcgaataagtttcggagcatcggttaacagcctatgggtgaaatttggctttcattcatgaatgagaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaaaaagagagaaaagaagaaaaaagaaggaacagcaacagagtgaagcaaatgagctcaggaatcttgcttttaagaaaattccccagaaatcctcccatgctgtttgtaacgctcaacatgatcttccattgtcaaacccagtacagaaggattcacgagaagaaaattggcaagagtggagacaaagagatgagcagatggggagtaggaggcaatgaggaagtcaagaggaaggggatctgaagtactccatcttggacacatctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactgaggaattgagttcttctcagactttatcacatgatggaggattcttcaatagactg

SEQ ID NO: 2464 - DNA, 403 bp, Homo sapiens
acccgactcccaggccggcgaccgctgagcctcccgagaccccgtgggggccgctcgagtgacaggttttgaagccgcttctctgcccgagttaggtttcgcccagcgcaatttctttctctatgtactttgcgaataagtttcggagcatcggttaacagcctatgggtgaaatttggctttcattcatgaatgagaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaa

SEQ ID NO: 2465 - DNA, 4211 bp, Homo sapiens
gggacggcggcgccgagtctgcgggtcctcccgccagcccggccggaggcagccgaggccgctcgggcggcggcggcggcggcggcgggagccggagcgcatctcgcccaggagccggagcagcggcactgcctgaaccagacagcagccttgggtgcaggcgtggtcatgagggcagatggacactgctgaagacccggcctggctccagctgcttcaaaaggattccagccccccaggaccccgacccacagccttcttctgcccacaggatgggagcctgggggctggcagctcggctatgagggattactgcccctcccagcaaaaggcaagccctgcaccccccaggcacacccctgaccaaagcccaggcatggagtctagacacagaagccccagtggggctggggaaggggcctcctgctctgacggccccagagggagcctggcctgcccctccccaacctgcttctctccccaggagtcaccctccaaggagacattggaggcacatggagcctccatctcagggacaccagaagccaccacgtctgggaagccagagcctgtgtcctccgtgaaaactgagcccaaatcctcagatgacagaaatcccatgttcttagagaagatggatttcaagtcctcaaagcaggccgattccacttccataggaaaggaggatcctgggtcctcacggaaggcagatcccatgtttacaggaaaggcagagcctgaaatcttgggaaagggggatcctgtggctcctggaaggatggatcccatgactgtaagaaaggaagatcttggatccctgggaaaagtagatcctttgtgctccagcaagacgtatacagtgtcaccgaggaaggaggatcctgggtctttgagaaaggtggatcctgtgtcctcagacaaagtggaccctgtattcccaagaaaggaggagcccaggtattcaggaaaagagcatcctgtgtcctcagaaaaggtcgctcctacatctgcagaaaaggtagatcttgtattgtcgggaaagagagatcctgggccctcgggaaaggcagatcccatgcccttggaaagcatggattctgcgtccacaggaaagacagagccggggctcctgggcaagctgattccaggctcatcaggcaagaatgggcctgtatcctctgggaccggggctcctgggtccttgggaaggctggatcccacatgcttggggatggcagatcccgcatctgtgggaaatgtagaaactgtgcctgccacaaaagaggactcccggttcctgggaaagatggaccctgcctcctcaggagaggggcgtcctgtgtctggccacacggatactacggcttcagcaaagacagatctcacatctttgaaaaatgtggatcccatgtcttcaggcaaggtggatccagtttctctgggaaagatggaccccatgtgctcaggaaagccagagctcttgtctcctggacaggcagagcgtgtgtctgtgggaaaggcaggaactgtatccccaggaaaagaggacccggtgtcctccagaagggaggaccccatatctgctggaagtagaaagacatcatctgaaaaagtgaatcctgagtcttcaggaaagacaaaccctgtgtcttcaggtccaggcgatcccaggtccttggggacagcaggtcccccatctgcagtaaaggctgagccagcgacggggggaaaaggagatcccctgtcctcggagaaggcaggtctggtggcctctggaaaggcggctcccacagcctcagggaaggccgagcccctcgcggtgggcaaggaggaccctgtgagcaagggaaaggcagacgctggcccctctggacaaggggactctgtgtctataggtaaagtggtctcaactccaggaaaaacagtcccggtgccctcggggaaggtggatcccgtgtccctgggaaaagcagaagctatcccagagggaaaagtgggttctctgcctctagagaaggggagtcctgttaccaccacaaaggcggatcccagggcctcggggaaagcacagccgcagtctggtggcaaagcagaaacaaagctccctgggcaagagggcgctgcagcaccaggggaagcaggggctgtgtgtttgaaaaaggagacaccacaggcctcagagaaggtggatcctggatcctgcagaaaagcagagccccttgcctcagggaagggagagcctgtgtccctggggaaagccgactctgcaccttccagaaaaacggagtccccatccttggggaaggtggtccccctgagtctggagaagaccaagccgtcctcctcctccaggcagttagaccgcaaagccctcggctcagcccggtctcccgagggtgccaggggcagtgaaggccgcgtggagccgaaggccgagcccgtgtccagcaccgaggcctccagtctcggccagaaagacctggaagccgctggggccgagagaagcccctgcccagaggccgcagcgcccccgccggggccgcggactcgcgacaacttcaccaaggcgccgtcgtgggaggcgagcgccccgccgccgccgcgcgaggacgcgggcactcaggcgggcgcgcaggcctgcgtctcagtggccgtgagccccatgtctccgcaggacggcgctgggggctcggccttcagcttccaggcggcgccgcgcgcgcccagcccgccctcgcgccgagatgcgggcctgcaggtgtcgctgggcgccgccgagacgcgctccgtggccactgggcccatgacacctcaagccgccgcgccgcccgccttccccgaagtgcgggtgcggcccggctcagcgctggcggccgctgtagcgcccccggagccggctgagcccgtgcgagacgtgagctgggacgagaagggcatgacgtgggaggtatacggcgccgccatggaggtggaggtgctgggcatggccatccagaagcatctggagcgacagatcgaggagcacggccgccaaggggcgcccgcgccgccgcccgccgcccgtgccggccccggccgttcgggctcggtgcgcaccgcgcccccagatggcgccgccaagcgtccgcccggcctgttccgcgcgctgctgcagagtgtgcgccggccgcggtgctgctcgcgggcgggacccacggccgagtgatctgcccccattttgtacgcccgagtttccgaccttctcaggctcccttcttgatcacaggcccctagaaggggtcccctctgcgtgccacaggcctccgaggggttgtgcagcctctagggctgttgcgtccccgtctttccagcccctcccatcacaaatacagaagaaccccttctaccaagctccctcgtggccacgaggccacgaacccggccagccctgacgccccactgtcccctcacagccctcagctctactcccggtcacactgggcgaccacgggggcctgctcagcaccctcacctcccaccccctgagagctggggcaggctcctgagatgtctagactggtgcgttgtggtctccggtggggccagatccccagaacagggagagactgcatacaagtctgagtggcagaagcttcaagtgggtgaggatcggtgtgtgagacccgcgagtgggcacgtctctgaatgtgaggtctcgggcagcacgtgaggtagaacgagtgtgagcgtctccacgcagtggctggccccgtggccggggcgtctcttgcatgctgttggtggtccttccccagttcctatctcccacccgcctggttccagccccatcccctctcccactgagtcacaggtttgagattcccagagaggccaaagacagctacaggaagtaccctgggggctcagctgagagagagtcacagaaaggccagagggtctcaggaaggtctggaggtcacagctgggctcacagaagctcttgggccctggcatcctgggtgaccggtgttcttgggtattggggacaggacagagagctcattctataaccacagttgtcttttaaaggccaccctctccagccccttgtcccccctgtgctgtgagcccaagtcccttgtgaccactcagtgtcccgtccccacccctccagccgcagtttttggctacaaactgtcacagtatacattggtaataaaatatttccccaa

SEQ ID NO: 2466 - DNA, 2397 bp, Homo sapiens
atggacactgctgaagacccggcctggctccagctgcttcaaaaggattccagccccccaggaccccgacccacagccttcttctgcccacaggatgggagcctgggggctggcagctcggctatgagggattactgcccctcccagcaaaaggcaagccctgcaccccccaggcacacccctgaccaaagcccaggcatggagtctagacacagaagccccagtggggctggggaaggggcctcctgctctgacggccccagagggagcctggcctgcccctccccaacctgcttctctccccaggagtcaccctccaaggagacattggaggcacatggagcctccatctcagggacaccagaagccaccacgtctgggaagccagagcctgtgtcctccgtgaaaactgagcccaaatcctcagatgacagaaatcccatgttcttagagaagatggatttcaagtcctcaaagcaggccgattccacttccataggaaaggaggatcctgggtcctcacggaaggcagatcccatgtttacaggaaaggcagagcctgaaatcttgggaaagggggatcctgtggctcctggaaggatggatcccatgactgtaagaaaggaagatcttggatccctgggaaaagtagatcctttgtgctccagcaagacgtatacagtgtcaccgaggaaggaggatcctgggtctttgagaaaggtggatcctgtgtcctcagacaaagtggaccctgtattcccaagaaaggaggagcccaggtattcaggaaaagagcatcctgtgtcctcagaaaaggtcgctcctacatctgcagaaaaggtagatcttgtattgtcgggaaagagagatcctgggccctcgggaaaggcagatcccatgcccttggaaagcatggattctgcgtccacaggaaagacagagccggggctcctgggcaagctgattccaggctcatcaggcaagaatgggcctgtatcctctgggaccggggctcctgggtccttgggaaggctggatcccacatgcttggggatggcagatcccgcatctgtgggaaatgtagaaactgtgcctgccacaaaagaggactcccggttcctgggaaagatggaccctgcctcctcaggagaggggcgtcctgtgtctggccacacggatactacggcttcagcaaagacagatctcacatctttgaaaaatgtggatcccatgtcttcaggcaaggtggatccagtttctctgggaaagatggaccccatgtgctcaggaaagccagagctcttgtctcctggacaggcagagcgtgtgtctgtgggaaaggcaggaactgtatccccaggaaaagaggacccggtgtcctccagaagggaggaccccatatctgctggaagtagaaagacatcatctgaaaaagtgaatcctgagtcttcaggaaagacaaaccctgtgtcttcaggtccaggcgatcccaggtccttggggacagcaggtcccccatctgcagtaaaggctgagccagcgacggggggaaaaggagatcccctgtcctcggagaaggcaggtctggtggcctctggaaaggcggctcccacagcctcagggaaggccgagcccctcgcggtgggcaaggaggaccctgtgagcaagggaaaggcagacgctggcccctctggacaaggggactctgtgtctataggtaaagtggtctcaactccaggaaaaacagtcccggtgccctcggggaaggtggatcccgtgtccctgggaaaagcagaagctatcccagagggaaaagtgggttctctgcctctagagaaggggagtcctgttaccaccacaaaggcggatcccagggcctcggggaaagcacagccgcagtctggtggcaaagcagaaacaaagctccctgggcaagagggcgctgcagcaccaggggaagcaggggctgtgtgtttgaaaaaggagacaccacaggcctcagagaaggtggatcctggatcctgcagaaaagcagagccccttgcctcagggaagggagagcctgtgtccctggggaaagccgactctgcaccttccagaaaaacggagtccccatccttggggaaggtggtccccctgagtctggagaagaccaagccgtcctcctcctccaggcagttagaccgcaaagccctcggctcagcccggtctcccgagggtgccaggggcagtgaaggccgccaagcgtccgcccggcctgttccgcgcgctgctgcagagtgtgcgccggccgcggtgctgctcgcgggcgggacccacggccgagtgatctgcccccattttgtacgcccgagtttccgaccttctcaggctcccttcttgatcacaggcccctag

SEQ ID NO: 2467 - DNA, 7209 bp, Homo sapiens
attattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaa

SEQ ID NO: 2468 - DNA, 7353 bp, Homo sapiens
attattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaaggtgacagcatgggacctcttcagcagagagcgaatctaagagcaggaagtcgcatagagtctcaccattttgcccaggctgatcttgaactcctggcctctagctgtcctcctgcctcagtctcccaaagggctgggattacagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaa

SEQ ID NO: 2469 - DNA, 6991 bp, Homo sapiens
tggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaaggtgacagcatgggacctcttcagcagagagcgaatctaagagcaggaagtcgcatagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaaccgtg

SEQ ID NO: 2470 - DNA, 1364 bp, Homo sapiens
tggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggttctt

SEQ ID NO: 2471 - DNA, 1916 bp, Homo sapiens
ggagtcggggaggaggtggctccagagatggcagtgagcgagaggagggggctcggccgcgggagccccgcggagtgggggcagcggctacttctggtgctgctgctgggtggctgctccgggcgcatccaccagctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacaggaaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggcta

SEQ ID NO: 2472 - DNA, 2009 bp, Homo sapiens
tcgctggggtcggccccctcccttcgggggcgaggctccatctcttggggactacaccccccttccccccaactgggtcttagtcctttaaattcttggaatcacttttggggcgctagagaccctggagccgcacagcggggtcctggggggctatagagtggggtcctctgggcacttaatgggatttggggggttctgttgaaatattgctgggagctcaactggaatgtaaaagttcttcgggaaggtgaaggtcaggcacgccgagggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacaggaaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagcta

SEQ ID NO: 2473 - DNA, 2142 bp, Homo sapiens
atggacatatcaatacaaagaaatggaagcatcgttgctgggtatgaagttgttggctccagcagtgcatctgaactgctgtcagccattgaacatgttgccgagaaggctaagacagcccttcacaagctgtttccattagaagacggctctttcagagtgttcggaaaagcccagtgtaatgacattgtctttggatttgggtccaaggatgatgaatataccctgccctgcagcagtggctacaggggaaacatcacagccaagtgtgagtcctctgggtggcaggtcatcagggagacttgtgtgctctctctgcttgaagaactgaacaagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattaccattgctgtcacgcaacctagcaatacctacaaaaggaaagatgtgtgttggcttaactggtccaatggaagcaaaccactcctggcttttgttgtccctgcactggctattgtggctgtgaacttcgttgtggtgctgctagttctcacaaagctctggaggccgactgttggggaaagactgagtcgggatgacaaggccaccatcatccgcgtggggaagagcctcctcattctgacccctctgctagggctcacctggggctttggaataggaacaatagtggacagccagaatctggcttggcatgttatttttgctttactcaatgcattccagggattttttatcttatgctttggaatactcttggacagtaagctgcgacaacttctgttcaacaagttgtctgccttaagttcttggaagcaaacagaaaagcaaaactcatcagatttatctgccaaacccaaattctcaaagcctttcaacccactgcaaaacaaaggccattatgcattttctcatactggagattcctccgacaacatcatgctaactcagtttgtctcaaatgaataa

SEQ ID NO: 2474 - DNA, 1370 bp, Homo sapiens
agatactgatactttctttccaaacagcataagaagtgattgagccacaagtatactgaaggaagggctccctcgagttctggtgtgaagagataaatcaccagtcacagactatgcacccgactgctgctgttcagtccagggaaaatgaaagttggagtgctgtggctcatttctttcttcaccttcactgacggccacggtggcttcctggggaaaaatgatggcatcaaaacaaaaaaagaactcattgtgaataagaaaaaacatctaggcccagtcgaagaatatcagctgctgcttcaggtgacctatagagattccaaggagaaaagagatttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcgaatgtcactcttgtcgcccaagttggagtgcaatggcacaatctaggctcactgcaaccctgcaacctctgcctaccgggttcaagagattcccctgcctcagcctcccaagtagctggaattacagacacctgccaccacatccagctaactttttttgtatttttagtagagacagggtttcaccatgttggccacactggtctcaaactcctgacctcaggtgatccgcctgcctcggcccccaaagtgctgggattacaggcatgagccaccacatctggcctaggaccttaaatattggaaagcattctcaaaactgtgggtcagtgagtagaactacaaaacaatagcagtagggcagaaacttgaaagaaggcaggagatcatggtgacagtggatgggaaaaagtgagggttggggataagggttgcgggttgtcgaagggtggattttctccttcagcaactacaggagatatgatgcctcataattcggagccagaagtggggctttgggtgagatatctttgcacagataacatgtatacatcatagttcaaaacccagtagtcattgtttacagcaaataaagaaatatttagtaaatta

SEQ ID NO: 2475 - DNA, 2086 bp, Homo sapiens
attgctgatggatcagtgagcctgtgttcatgccagtgagctgctgtggctcagatactgatactttctttccaaacagcataagaagtgattgagccacaagtatactgaaggaagggctccctcgagttctggtgtgaagagataaatcaccagtcacagactatgcacccgactgctgctgttcagtccagggaaaatgaaagttggagtgctgtggctcatttctttcttcaccttcactgacggccacggtggcttcctggggaaaaatgatggcatcaaaacaaaaaaagaactcattgtgaataagaaaaaacatctaggcccagtcgaagaatatcagctgctgcttcaggtgacctatagagattccaaggagaaaagagatttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcgaaatggaagcatcgttgctgggtatgaagttgttggctccagcagtgcatctgaactgctgtcagccattgaacatgttgccgagaaggctaagacagcccttcacaagctgtttccattagaagacggctctttcagagtgttcggaaaagcccagtgtaatgacattgtctttggatttgggtccaaggatgatgaatataccctgccctgcagcagtggctacaggggaaacatcacagccaagtgtgagtcctctgggtggcaggtcatcagggagacttgtgtgctctctctgcttgaagaactgaacaagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcagaggaaaaaaaaacag

SEQ ID NO: 2476 - DNA, 5468 bp, Homo sapiens
agtaatgcgtgccaggaattgctgatggatcagtgagcctgtgttcatgccagtgagctgctgtggctcagatactgatactttctttccaaacagcataagaagtgattgagccacaagtatactgaaggaagggctccctcgagttctggtgtgaagagataaatcaccagtcacagactatgcacccgactgctgctgttcagtccagggaaaatgaaagttggagtgctgtggctcatttctttcttcaccttcactgacggccacggtggcttcctggggaaaaatgatggcatcaaaacaaaaaaagaactcattgtgaataagaaaaaacatctaggcccagtcgaagaatatcagctgctgcttcaggtgacctatagagattccaaggagaaaagagatttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcgaaatggaagcatcgttgctgggtatgaagttgttggctccagcagtgcatctgaactgctgtcagccattgaacatgttgccgagaaggctaagacagcccttcacaagctgtttccattagaagacggctctttcagagtgttcggaaaagcccagtgtaatgacattgtctttggatttgggtccaaggatgatgaatataccctgccctgcagcagtggctacaggggaaacatcacagccaagtgtgagtcctctgggtggcaggtcatcagggagacttgtgtgctctctctgcttgaagaactgaacaagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattaccattgctgtcacgcaacctagcaatacctacaaaaggaaagatgtgtgttggcttaactggtccaatggaagcaaaccactcctggcttttgttgtccctgcactggctattgtggctgtgaacttcgttgtggtgctgctagttctcacaaagctctggaggccgactgttggggaaagactgagtcgggatgacaaggccaccatcatccgcgtggggaagagcctcctcattctgacccctctgctagggctcacctggggctttggaataggaacaatagtggacagccagaatctggcttggcatgttatttttgctttactcaatgcattccagggattttttatcttatgctttggaatactcttggacagtaagctgcgacaacttctgttcaacaagttgtctgccttaagttcttggaagcaaacagaaaagcaaaactcatcagatttatctgccaaacccaaattctcaaagcctttcaacccactgcaaaacaaaggccattatgcattttctcatactggagattcctccgacaacatcatgctaactcagtttgtctcaaatgaataaggcaaggaatcataaaatcaagaaaaaatttccagaacaacttgacatttagagacaaatgtcaatgaagaaattatgctcagtattcgatcgggttttctgatttaggggtctgggaataaaacaagaatgtctcagtggcttcattactgctcccttttgtcttcaattaaatgaaaagaagatttatttccatgtgatttgattcaaagaaagtgctccataaatgcagaagagtaggttttgttggaaatcgtgtcagttgtaccctgaccataaaatatggtttctattttcataaaacagcattattcacatggcatttccaataatctggattgaaggaagaaaattttatgaaatagctttagataaattaataggccacgttcattttcttgtcaaaaagttactggtggggggatggtgggaaaaagttattagtgcaaatttcctagagaaaaaaccatttctctttcaaattttccagttgaattttatgttcgcttttgcttcttaggttctatcacttaatattgaaagttaatcagaaataaaatgtaaacttctatttcagatagctttgtaaccatttatcagaaagtataataatgtgatatgatatataatgtggtatttttcagtttacaaggcacttccatctggtcctaaaccctgcaaacaaaagtgtcaaggcagacctagtgcagagatgagggcatgggggctcagagaggtaaagtgacttgccaaagattgtgaagccagttaagggaaattggggatttttaggacatttgtctcccagaccatttctacagccaataaaagccttgaaaattacctacatctctagtaaatctttctgaggtcagttacacagttcaccattcccagaattctatgtaagagagaaattaagggagaatttggttgtcagcttccagggaggtaccttaaaacatccttattttctttcataatacaccataggcactttgtggaagttattttcttgtacagccagtgccacttttggatgacatacaaagcagcaggagttgacgctatgtgaagcaacacttctcttccatacttccatcacatttggctcacctacctgagtttcagccgtgaccatagtgcccagaggaacccgagcctttgattcatccttgctgttttgagaggcctagggagtgtctcttagcctcctgacatggaaagccttcatgctatgcaaataaagacagctgggggaacttctagttagtggtggtagattaaataagcatacctgagagaaattcaaagttagacttccacaaggcaccaaggtgcagcacacatgaaatatgaaagtgagaggttcaaaggaaatgactgaggatcagttagatggttctataccccacaaatatgtatgagagtcaacagaattttatgagaaagacttctttgcagaaaactgctctatgagccttctcactctacctacccacaaaagtgagagaaggaggaatgtctgctccttgacctcaaatttagtgagagaagatttctcagatagctcagatagctcagatttctcagaaccacaacaattaggatgcatggctgatggaagtctgattcttgcctagaattgtggccacagctccggtagtagagccctgaatgagttctgtgttgagaatagcctgtatgtctagtgtttgtcagggcaatggatgtgtgtgtttcccatgaaccatagtgagacatgcaagagtgaaggtcagcatggggctcttttaggtcctctctgatagggttgtccaaagaggtggagggaacccagcatcaagaagtgggaggtgaagccagattgtgggatgaggaaggagtcacaaatgaccacctggaatacaaaaaaatctacacaagctaaagatgagaagtcagggctatgagaatttctatgggagttcttgaatgctccctctcttattacacacaattactatccagagaaccctgacaccatgtgaaggcagccctatctcataagacagatttctttttttggggaccttggggaaagggaggccagaaacctccgtgtccaaggtggggtggaaggagagggagaaatcttagcaaaaatgtcaaccagcaagggaagatgtgctagcgcaagtaggcaactcaacacaagactcagttggagagggaagaaaaatttagtactaaattattgtagtttcttcttattgtaggcgactgggagtcataattaccaaactatttaaaatgaccaaaatgttgctcttacctgagtatgttggcatacaactggaatgtatctgatggaagaaaaagcttctcccactgaataaattttatgaggatgatgagagacaaaaaaatgtttgatcagatatcatgtatgtgcatgcttgtctaattcactgattatgcatacattcacctcaaaatgctactaaaacaacaataaaataatgaaaaagtgaatagca

SEQ ID NO: 2477 - DNA, 2127 bp, Homo sapiens
atggggctgactgcctatgggaaccgcagggtccagcctggggagctgccattcggggctaacttgactctcatccatacaagagcccagcctgtgatttgtagcaagcttctcttgacaaagagagtgagtcccatctctttcttcttgtccaaatttcaaaattcctggggtgaggatggatgggttcagttggatcaactgccatcccctaatgcagtcagctctgaccaagtacactgttcagctggctgcacacacaggaaatgtggatgggctgcaagcaaaagcaaggagaaggtgcctgccaggccacacggtgtatgcgatggtgtctgtacagactactcccagtgtactcaaccttgccctccagacactcagggaaatatggggttttcatgcaggcaaaagacatggcacaagatcactgacacctgccagactcttaatgccctcaacatctttgaggaggattcacgtttggttcagccatttgaagacaatataaaaataagtgtatatactggaaagtctgagaccataacagatatgttgctacaaaagtgtcccacagatctgtcttgtgtaattagaaacattcagcagtctccctggataccaggaaacattgccgtaattgtgcagctcttacacaacatatcaacagcaatatggacaggtgttgatgaggcaaagatgcagagttacagcaccatagccaaccacattcttaacagcaaaagcatctccaactggactttcattcctgacagaaacagcagctatatcctgctacattcagtcaactcctttgcaagaaggctattcatagataaacatcctgttgacatatcagatgtcttcattcatactatgggcaccaccatatctggagataacattggaaaaaatttcactttttctatgagaattaatgataccagcaatgaagtcactgggagagtgttgatcagcagagatgaacttcggaaggtgccttccccttctcaggtcatcagcattgcatttccaactattggggctattttggaagccagtcttttggaaaatgttactgtaaatgggcttgtcctgtctgccattttgcccaaggaacttaaaagaatctcactgatttttgaaaagatcagcaagtcagaggagaggaggacacagtgtgttggctggcactctgtggagaacagatgggaccagcaggcctgcaaaatgattcaagaaaactcccagcaagctgtttgcaaatgtaggccaagcaaattgtttacctctttctcaattcttatgtcacctcacatcttagagagtctgattctgacttacatcacatatgtaggcctgggcatttctatttgcagcctgatcctttgcttgtccattgaggtcctagtctggagccaagtgacaaagacagagatcacctatttacgccatgtgtgcattgttaacattgcagccactttgctgatggcagatgtgtggttcattgtggcttcctttcttagtggcccaataacacaccacaagggatgtgtggcagccacattttttgttcatttcttttacctttctgtatttttctggatgcttgccaaggcactccttatcctctatggaatcatgattgttttccataccttgcccaagtcagtcctggtggcatctctgttttcagtgggctatggatgccctttggccattgctgccatcactgttgctgccactgaacctggcaaaggctatctacgacctgagatctgctggctcaactgggacatgaccaaagccctcctggccttcgtgatcccagctttggccatcgtggtagtaaacctgatcacagtcacactggtgattgtcaagacccagcgagctgccattggcaattccatgttccaggaagtgagagccattgtgagaatcagcaagaacatcgccatcctcacaccacttctgggactgacctggggatttggagtagccactgtcatcgatgacagatccctggccttccacattatcttctccctgctcaatgcattccaggtaagtccagatgcttctgaccaagtgcaaagtgagagaattcatgaagatgttctgtga

SEQ ID NO: 2478 - DNA, 4895 bp, Homo sapiens
ctttttatttctttttatagaaacaagaaagtcagctgtgtggaagacaatgactcatatacttttgctgtactacttggtgtttcttttgcccacagagtcctgtaggacattgtatcaggctgcaagcaaaagcaaggagaaggtgcctgccaggccacacggtgtatgcgatggtgtctgtacagactactcccagtgtactcaaccttgccctccagacactcagggaaatatggggttttcatgcaggcaaaagacatggcacaagatcactgacacctgccagactcttaatgccctcaacatctttgaggaggattcacgtttggttcagccatttgaagacaatataaaaataagtgtatatactggaaagtctgagaccataacagatatgttgctacaaaagtgtcccacagatctgtcttgtgtaattagaaacattcagcagtctccctggataccaggaaacattgccgtaattgtgcagctcttacacaacatatcaacagcaatatggacaggtgttgatgaggcaaagatgcagagttacagcaccatagccaaccacattcttaacagcaaaagcatctccaactggactttcattcctgacagaaacagcagctatatcctgctacattcagtcaactcctttgcaagaaggctattcatagataaacatcctgttgacatatcagatgtcttcattcatactatgggcaccaccatatctggagataacattggaaaaaatttcactttttctatgagaattaatgataccagcaatgaagtcactgggagagtgttgatcagcagagatgaacttcggaaggtgccttccccttctcaggtcatcagcattgcatttccaactattggggctattttggaagccagtcttttggaaaatgttactgtaaatgggcttgtcctgtctgccattttgcccaaggaacttaaaagaatctcactgatttttgaaaagatcagcaagtcagaggagaggaggacacagtgtgttggctggcactctgtggagaacagatgggaccagcaggcctgcaaaatgattcaagaaaactcccagcaagctgtttgcaaatgtaggccaagcaaattgtttacctctttctcaattcttatgtcacctcacatcttagagagtctgattctgacttacatcacatatgtaggcctgggcatttctatttgcagcctgatcctttgcttgtccattgaggtcctagtctggagccaagtgacaaagacagagatcacctatttacgccatgtgtgcattgttaacattgcagccactttgctgatggcagatgtgtggttcattgtggcttcctttcttagtggcccaataacacaccacaagggatgtgtggcagccacattttttgttcatttcttttacctttctgtatttttctggatgcttgccaaggcactccttatcctctatggaatcatgattgttttccataccttgcccaagtcagtcctggtggcatctctgttttcagtgggctatggatgccctttggccattgctgccatcactgttgctgccactgaacctggcaaaggctatctacgacctgagatctgctggctcaactgggacatgaccaaagccctcctggccttcgtgatcccagctttggccatcgtggtagtaaacctgatcacagtcacactggtgattgtcaagacccagcgagctgccattggcaattccatgttccaggaagtgagagccattgtgagaatcagcaagaacatcgccatcctcacaccacttctgggactgacctggggatttggagtagccactgtcatcgatgacagatccctggccttccacattatcttctccctgctcaatgcattccagggtttcttcatcctagtgtttggaaccatcctggatccaaagataagagaagccttaaagggttgagtagcctctgcaaaaaggagctccagaatatcagagaatgcttcttctgaattatcttgtcatcccatcaaaggcccaagttaacaaaccaggctacatccctaacctaggaggaatggcagagcccaaaggagaaatgtgctcattcctgtcttcttgcttctggagaatatgtaggaagctcacacatgtggtgctgatggaggagggcgtgatgtgcagaaaggatgaaaggctcctctgtctaagctgttctgtgctactaaacatttctcgtccatcaactgtacatagctacatatgtcatgctgggcagccacagcaaacaaaaagacaaagggggccacaaccgtggtttttgttggggcttccatctctatgctgttgggtcacatttgtcttcagaaagcaacctctgtctcatcttggaaaaggcggcctgagatttcacctggctggattctgtgtgttgctgagggaggagcctcatgaatagtcacaaagagttgggctgactctaagtaggacattgcagattatttttttttttcaaaaggaatccactgccagtatatccactttttcaaatttaaatagattggattgtcaacttggtttaggcttagatacaacttccttggccatgaaccaaggggaaaagcatagagcttttgagacagaaagatgaccattttcagttaaggagatggaagtctggagttgtgagtcaatgctaatcgaggactgagccagaggtagaaacccaagtgtgctggctcccagccctgtacttcctcttcaagaccatatagacactgaaagatcttctgcctacactgacaatgtaaggtcaatcctcaccaacaatatgcttttttgatacctgggattggagagaggaaatatcacatttccaattcagagctgctctttttcttaacctgtatgtaaacaaattcaacattcaaaccaggtgttacctgatagaacagtattgtaggtagaagctctttgaggaaaaaaaaaaaacctctttacaaagcaaggacatagatgactgcagcagcatctaactagtggatgaaggcaaaggggcaatgggcagcctttaattatcccaacaagaagtcagtattgatgacgtttcattacaaaggagaaagtggggctcaccttaggtatgagtgcagtcccttccttccttccttccttccttccttccttccttccttccttccttccttccttccttccttccttccttccttcttccctccctccctccctctctctctctctttctccctttctctttctttctttttttctccctctctctctttctttctttctttgtttcttattacaaataatcttcctataagtaggaaagtttgagcagacaaaaagcatcaatctgaagttaaaaaaaatgcatcaacctggagaaatagtcatttttcaaatggcattgcttatcttgggacaacaaaagcatccttcacaaataaagtcagagagtggttttaatttaccatttaccaatagatttgtatgttcttttcaagagaaggggtgagatagacatagtcctggttttcctcaatgcaggcttaggtacaaagagatgtcacttacccagagtccatatattgaagtgaaaatggaatttcatgaagcaaatatagttataggatggtaactctggacaaattttataaaagatgaactccaattgcttcatttcacagataacagctctgagcactagggagagagggagggattggcctagcatttgctttgtgtcttgagcagtcacatctattatggaagtactcactactcagctatactcactccctgagacaggatggttggaaagaaaccccaccttagcttcatcattaaccaagaaaccccaaggatgcttagagaaaaactctggaattatttgggaattcctggaagaagctatgccctctctcctgcatcccaaagcccactctacaccatcttgaaaaatgtcaaggaactgcatggattaggttgactctggatgaccctgggtagagacacattcagtttcctgctgacaccgcaccaagaaagtgatttggtcaggtgactctaggagaaattggtactgatagtatccaaggcagatttttaagtatcagacttaatacataatgattcttgggaaagccatttaaatccctgagactttaagtggataaatgtaggtaaagtagtatagtacttggctcataataattgctcattcaaattcacatgttagttttagttgttttttttaaattagagtcctgtgaatacatgaacccacccacccacatgcaaacacaagcaaacacacagccatgaccccatgcataagtttggctgaagacaccctcatgggaactagttcactgacttccaaattaaagagttaagcatttgatttggtctgttcaacattaggggtatcagccagcaaaatctgttgagcttaccattgaaaaatcctttcattcattactgtggtcataatacacagttacctggccaggaaagagtacacatcacagggatctgctcactgcacgtgtgcctgagctctccctcactttctgccttcttcaagaattcttccctgattggtccaaccagaagcgctgattctccccacctgatttcctgtaattttataatctatgtccttcacttttgtgttatattgtttatttccttttggtctttttgtgtgcatatgtatatgttttggggaatggggtattcacttttgttactcactgtgttactcacttttgtatgcccatagtgcagagcatggtgccttgtacatagagtatgttcggtaaatatgtgcaataaaaagtcctttgattac

SEQ ID NO: 2479 - DNA, 5126 bp, Homo sapiens
gcaaggtatgacagaagagagccagtaatgcccatatctccagctgccagggagtggggcaaatttgccgtagagacggggtttcaccgtgttagccaggatggtctcgatctcctgacctcgtgatctgcgcacctcggcctcccaaagtgctgggattacagatatgaaccatcgcgcccggcccagaagatgacttcttgactcctctctctccgtatctgacactacttcattctttaccaggaaacaagaaagtcagctgtgtggaagacaatgactcatatacttttgctgtactacttggtgtttcttttgcccacagagtcctgtaggacattgtatcaggctgcaagcaaaagcaaggagaaggtgcctgccaggccacacggtgtatgcgatggtgtctgtacagactactcccagtgtactcaaccttgccctccagacactcagggaaatatggggttttcatgcaggcaaaagacatggcacaagatcactgacacctgccagactcttaatgccctcaacatctttgaggaggattcacgtttggttcagccatttgaagacaatataaaaataagtgtatatactggaaagtctgagaccataacagatatgttgctacaaaagtgtcccacagatctgtcttgtgtaattagaaacattcagcagtctccctggataccaggaaacattgccgtaattgtgcagctcttacacaacatatcaacagcaatatggacaggtgttgatgaggcaaagatgcagagttacagcaccatagccaaccacattcttaacagcaaaagcatctccaactggactttcattcctgacagaaacagcagctatatcctgctacattcagtcaactcctttgcaagaaggctattcatagataaacatcctgttgacatatcagatgtcttcattcatactatgggcaccaccatatctggagataacattggaaaaaatttcactttttctatgagaattaatgataccagcaatgaagtcactgggagagtgttgatcagcagagatgaacttcggaaggtgccttccccttctcaggtcatcagcattgcatttccaactattggggctattttggaagccagtcttttggaaaatgttactgtaaatgggcttgtcctgtctgccattttgcccaaggaacttaaaagaatctcactgatttttgaaaagatcagcaagtcagaggagaggaggacacagtgtgttggctggcactctgtggagaacagatgggaccagcaggcctgcaaaatgattcaagaaaactcccagcaagctgtttgcaaatgtaggccaagcaaattgtttacctctttctcaattcttatgtcacctcacatcttagagagtctgattctgacttacatcacatatgtaggcctgggcatttctatttgcagcctgatcctttgcttgtccattgaggtcctagtctggagccaagtgacaaagacagagatcacctatttacgccatgtgtgcattgttaacattgcagccactttgctgatggcagatgtgtggttcattgtggcttcctttcttagtggcccaataacacaccacaagggatgtgtggcagccacattttttgttcatttcttttacctttctgtatttttctggatgcttgccaaggcactccttatcctctatggaatcatgattgttttccataccttgcccaagtcagtcctggtggcatctctgttttcagtgggctatggatgccctttggccattgctgccatcactgttgctgccactgaacctggcaaaggctatctacgacctgagatctgctggctcaactgggacatgaccaaagccctcctggccttcgtgatcccagctttggccatcgtggtagtaaacctgatcacagtcacactggtgattgtcaagacccagcgagctgccattggcaattccatgttccaggaagtgagagccattgtgagaatcagcaagaacatcgccatcctcacaccacttctgggactgacctggggatttggagtagccactgtcatcgatgacagatccctggccttccacattatcttctccctgctcaatgcattccagggtttcttcatcctagtgtttggaaccatcctggatccaaagataagagaagccttaaagggttgagtagcctctgcaaaaaggagctccagaatatcagagaatgcttcttctgaattatcttgtcatcccatcaaaggcccaagttaacaaaccaggctacatccctaacctaggaggaatggcagagcccaaaggagaaatgtgctcattcctgtcttcttgcttctggagaatatgtaggaagctcacacatgtggtgctgatggaggagggcgtgatgtgcagaaaggatgaaaggctcctctgtctaagctgttctgtgctactaaacatttctcgtccatcaactgtacatagctacatatgtcatgctgggcagccacagcaaacaaaaagacaaagggggccacaaccgtggtttttgttggggcttccatctctatgctgttgggtcacatttgtcttcagaaagcaacctctgtctcatcttggaaaaggcggcctgagatttcacctggctggattctgtgtgttgctgagggaggagcctcatgaatagtcacaaagagttgggctgactctaagtaggacattgcagattatttttttttttcaaaaggaatccactgccagtatatccactttttcaaatttaaatagattggattgtcaacttggtttaggcttagatacaacttccttggccatgaaccaaggggaaaagcatagagcttttgagacagaaagatgaccattttcagttaaggagatggaagtctggagttgtgagtcaatgctaatcgaggactgagccagaggtagaaacccaagtgtgctggctcccagccctgtacttcctcttcaagaccatatagacactgaaagatcttctgcctacactgacaatgtaaggtcaatcctcaccaacaatatgcttttttgatacctgggattggagagaggaaatatcacatttccaattcagagctgctctttttcttaacctgtatgtaaacaaattcaacattcaaaccaggtgttacctgatagaacagtattgtaggtagaagctctttgaggaaaaaaaaaaaacctctttacaaagcaaggacatagatgactgcagcagcatctaactagtggatgaaggcaaaggggcaatgggcagcctttaattatcccaacaagaagtcagtattgatgacgtttcattacaaaggagaaagtggggctcaccttaggtatgagtgcagtcccttccttccttccttccttccttccttccttccttccttccttccttccttccttccttccttccttccttccttcttccctccctccctccctctctctctctctttctccctttctctttctttctttttttctccctctctctctttctttctttctttgtttcttattacaaataatcttcctataagtaggaaagtttgagcagacaaaaagcatcaatctgaagttaaaaaaaatgcatcaacctggagaaatagtcatttttcaaatggcattgcttatcttgggacaacaaaagcatccttcacaaataaagtcagagagtggttttaatttaccatttaccaatagatttgtatgttcttttcaagagaaggggtgagatagacatagtcctggttttcctcaatgcaggcttaggtacaaagagatgtcacttacccagagtccatatattgaagtgaaaatggaatttcatgaagcaaatatagttataggatggtaactctggacaaattttataaaagatgaactccaattgcttcatttcacagataacagctctgagcactagggagagagggagggattggcctagcatttgctttgtgtcttgagcagtcacatctattatggaagtactcactactcagctatactcactccctgagacaggatggttggaaagaaaccccaccttagcttcatcattaaccaagaaaccccaaggatgcttagagaaaaactctggaattatttgggaattcctggaagaagctatgccctctctcctgcatcccaaagcccactctacaccatcttgaaaaatgtcaaggaactgcatggattaggttgactctggatgaccctgggtagagacacattcagtttcctgctgacaccgcaccaagaaagtgatttggtcaggtgactctaggagaaattggtactgatagtatccaaggcagatttttaagtatcagacttaatacataatgattcttgggaaagccatttaaatccctgagactttaagtggataaatgtaggtaaagtagtatagtacttggctcataataattgctcattcaaattcacatgttagttttagttgttttttttaaattagagtcctgtgaatacatgaacccacccacccacatgcaaacacaagcaaacacacagccatgaccccatgcataagtttggctgaagacaccctcatgggaactagttcactgacttccaaattaaagagttaagcatttgatttggtctgttcaacattaggggtatcagccagcaaaatctgttgagcttaccattgaaaaatcctttcattcattactgtggtcataatacacagttacctggccaggaaagagtacacatcacagggatctgctcactgcacgtgtgcctgagctctccctcactttctgccttcttcaagaattcttccctgattggtccaaccagaagcgctgattctccccacctgatttcctgtaattttataatctatgtccttcacttttgtgttatattgtttatttccttttggtctttttgtgtgcatatgtatatgttttggggaatggggtattcacttttgttactcactgtgttactcacttttgtatgcccatagtgcagagcatggtgccttgtacatagagtatgttcggtaaatatgtgcaataaaaagtcctttgattacacaa

SEQ ID NO: 2480 - DNA, 8784 bp, Homo sapiens
aggctgtgtgaccccacgttggggacaggtcacaaaacctaagccttgtgcctactggaaagaagaagcagtggagtccttgacagaagcagtggtgctggaacctggtgctaggcgctgggccaagcactttacatactgtgtgttatgtaatcttcacagcaatatgagacttagacaatgaaagaacacatcatatatcagaagctttatggattgattctcatgtcgagttttatctttctctcagatacactttcactaaaaggaaaaaagctggatttttttggaagaggtgacacatatgtaagcctgatagataccattcctgaactcagccgattcacagcatgcattgatctggtattcatggatgacaactcaaggtattggatggccttctcttatattactaataacgccctcctgggcagagaagacatagaccttggacttgcaggagaccatcagcagctaatactatacagattgggaaagaccttttctatccgtcaccacctggcttcatttcaatggcatacaatatgcttgatatgggatggtgtgaagggcaaattagaactcttcctgaataaagaaaggatactggaagtaacggatcaaccacacaacctgacacctcatgggactctgttcctagggcactttctcaagaatgagagcagcgaggttaaaagcatgatgcgtagctttcctggcagcttgtactactttcaactctgggaccacatcctggaaaacgaagagtttatgaagtgtttagatggaaatatagttagttgggaagaagacgtctggcttgtcaacaagatcatcccaactgttgacaggacactgcgctgctttgttcctgaaaatatgacaattcaagaaaaaagtacaactgtttcacaacagatagatatgaccactccatcccaaattactggagtaaaaccacaaaatactgcacattcctctacactattgtctcaaagcatacctatatttgcaactgattacacaaccatatcatattccaatacaacatctccacctctggaaacaatgactgcacaaaaaatcttaaagacactggtagatgagacagctacatttgcagtggatgttttatcaacttcatcagccatctctctgcctacccagagtatatccatagacaatactaccaattccatgaaaaaaacgaaatctccatcttcagaaagcacaaagacaacaaaaatggttgaagccatggctactgaaatctttcaaccacctacaccttctaatttcctatccacatccagatttaccaagaattcagttgtatctacaacttcagcaattaaatctcagtcggctgttacgaagacaacatctttattttcaactattgagtcaacatctatgtctacaacaccttgtctcaaacaaaaatccacaaatactggggcactccctatctccacagctggccaggagttcattgaatctacagctgccggaactgtaccttggtttacagtggaaaagacttcacctgcatctactcatgttgggactgcatcatcattcccacctgagcctgtgctcatctccacagctgctccagtagattctgtatttcctagaaaccagacagcatttccattggcaacaactgatatgaaaatagcatttacagtccattcattgactctcccaactaggcttattgagaccacacctgccccaaggacagctgaaacagaattgacatctacaaattttcaggatgtctctttacccagagtggaagatgccatgtctacttccatgtcgaaagagacctcctctaagaccttttctttcttaacatccttttcatttactgggactgagagtgtacagacagttattgatgctgaagctacacgtacagccttaactcctgaaatcacacttgcatctacagtggctgaaactatgctttcctccacaatcacaggacgagtttacacccagaatacacctacagctgatggacacttgcttactttgatgtccactagatcagcttccacatccaaggcacctgagtcaggtcccacatccacaactgatgaagctgcccatctgttctccagcaatgagaccatttggacttctaggccagaccaggccctgctggcatctatgaacacaaccaccatactcacatttgtgcctaatgaaaattttacatcagcatttcatgagaatactacttatacagaatatttatccgcaactaccaatatcaccccactgaaagcatctccagagggcaaaggtaccactgccaatgatgctactacagccagatatacaacagctgtatccaaattgacatcaccatggtttgctaatttctccatagtttctggaaccacatccataaccaatatgcctgaatttaaacttaccactttactactaaaaacaatacctatgtctacaaaacctgcaaatgaacttcctttgacaccaagggagactgttgttccatcagtagatataatatctactcttgcttgcattcaaccaaatttttctactgaggaaagtgcttctgagaccacacaaacagaaataaatggtgcaattgtatttggaggtacaacgacccctgtaccaaagtcagcaacaacacaaagattaaatgccactgtgacaagaaaagaagcaacttcccattatcttatgagaaaatcaactatagcagcagtggctgaggtttctccattttcaacaatgctggaagtgacagacgaatcagcacaaagggtgacagcttctgtcactgtttcctcttttcctgatatagaaaagctaagtaccccattggataataaaactgcaacaactgaggtgagagaaagttggcttttgacaaaattggtgaaaaccacacctaggagttcatacaatgaaatgacagaaatgtttaattttaaccacacctatgtagcacattggacttcagagacatctgagggaatttcagctggatctcccacttctgggagcacacatatattcggtgaacccctgggtgcttctaccacaaggatatcagaaaccagtttctccactacccctacagacaggacagctacgtccttgtctgatggtatcttacctccacagcctacagctgctcattcctcagcaacccctgtgcctgttactcatatgttctcattgccagttaatggcagttctgtggtggctgaggagactgaggttaccatgtctgagccttctacactggccagggctttttctacatctgtgctctcagatgtctcaaatctatcctcaactacaatgaccacagcattggtaccacctttggatcagactgcttccacaaccattgttattgtgcctacccatggagacttgattcgtaccacttcagaggccacggtaatctctgtcaggaagacatccatggcagttccttctctgacagaaacaccatttcattcactgagactctccactcctgtgacagctaaggctgagaccacccttttctctacctcagttgatacagtaaccccatctacacacactcttgtctgctcaaaacctccccctgacaacattcctcctgcgtcctccactcatgtgatctcaactacgtctacaccagaagcaactcaaccaatatctcaagtagaggagacttctacctatgctctcagcttcccatatactttcagtggtggtggagttgttgccagcttggctactggcaccacagagacctctgttgttgatgagaccacaccctcacacatctctgccaataagttgactacttcagtaaacagtcacatttcttcatctgccacatatcgtgtacacacaccagtgtccatccagttggtgactagcacctctgtcttatcttccgacaaagaccagatgaccatatccctgggaaaaacccctagaactatggaggtgacagaaatgtccccatcaaagaattcttttatttcatactcccggggtactccatctttggaaatgacagatacaggatttcctgagaccacaaaaatttccagtcaccaaacacattcgccttcagagattccacttgggactccctctgatggaaatttggcttcatctcccacttctggaagcacacagattacaccaaccttgacctcaagtaacacagtaggtgttcacattccagaaatgtctaccagtcttgggaaaacagctctcccctcacaagctctgacaatcaccacttttttgtgtcctgaaaaggaaagcacgagtgcccttccagcatatactcccaggactgtggaaatgatagtaaactccacctatgtgactcactctgtctcatatggccaggatacttcatttgtagataccacaacttccagctcaacaaggatatcaaatcctatggacatcaatacaactttttcacacttgcattcacttaggacacaacctgaggtgacttcagttgcctctttcatttctgaaagcacacagactttccctgagtccttgtctctttccacagctggactatataatgacggttttacagttctctccgacaggatcactacagccttttctgttccaaatgtacctacaatgcttcctagagaatcctctatggcaacgtccactcctatttaccagatgtcctcattgccagttaatgtaactgccttcacctccaaaaaagtttctgacactcccccaatagtgataactaaatcttctaaaacaatgcatccaggttgtttgaaaagtccctgtacagccacttctgggcctatgtctgagatgtcctcaataccagttaataactctgctttcacacctgcaacagtctcttctgacacttccacaagagttgggttattctctactttattgtcttcagttacccccaggactactatgaccatgcaaacatctacattggatgtcacacctgtgatatatgctggggctacttcaaaaaacaaaatggtttcctctgctttcactacagaaatgatagaggcaccttccaggatcacacctacgacctttctctctccaacagagccaactttgccctttgtaaaaaccgttcccaccaccattatggctgggatagtgactccatttgtaggcaccactgccttctctccactcagttctaagagcactggagctatttcctccattccaaagaccacattttcaccatttctatcagcaactcaacagtcatcacaagcagatgaggctacaactttgggcatattatctgggattactaacaggtccctatctactgtgaacagtggtacaggggtagctctcacagatacttattccagaatcactgttcctgaaaatatgctttcacctactcatgcagatagtctccatacttccttcaatattcaggtttccccatctctgactagctttaagagtgcttctggacccacaaaaaatgttaaaacaaccaccaattgcttttcttctaatactagaaagatgacttccttgttagaaaagacttccttaacaaactatgccacatctttgaatacccctgtttcataccctccatggaccccatccagtgcaactctaccctctttgacatcatttgtttattcacctcatagtactgaagctgagatctctactccaaagacctctcctcctcccacatcccaaatggttgaatttccagttctgggaacaagaatgacatctagtaatacccaacctctgcttatgacttcctggaacatacccacagctgaaggttctcagtttccaatttccaccactattaatgtacctacatccaatgagatggaaacagagactctacaccttgttcctgggcctttgtcaacattcacagcctctcagactggtctagtatctaaagatgtcatggcaatgtcatcaattcctatgtcaggaattcttcctaaccatgggctttctgagaacccttcattatcaacatctttaagagctatcacttccacattggctgacgttaagcacacatttgagaaaatgaccacatctgtaactcctgggaccacactcccatcaattctttctggtgccacttcaggatctgtaatttcaaagtcacccattctgacatggctcttatctagtctcccttctggctcccctccggcaactgtatctaatgcccctcatgttatgacttcctctacagtagaggtgtcaaaatcaacatttctgacatctgacatgatatcagcgcacccattcactaacttgacaacactaccctctgctactatgagcaccatactcacccgaaccattcctacacctacactgggtggtatcactactggcttcccaacttctctccctatgtctataaatgtcacagatgacattgtgtacatttccacacaccctgaggcatcctccagaaccacaataactgccaaccccaggactgtgtctcatccttcatccttcagcagaaagactatgtcaccttctacaactgaccacactctatctgttggtgccatgcctctgcctagctctacaataacatcttcatggaacagaattccaactgcatcatcaccctctactttaattattcctaagcccacactggactcccttctaaatataatgactactacatccactgttcctggagcctcatttccactcatatccactggggtgacatatccttttacagcaactgtgtcttcaccaatatcgtccttttttgaaacaacttggctggactccacaccttcctttctatctacggaagcatcgacttcgcctactgccaccaagtccacagagcctggaaattgcaaagctgatgaaacagcctctaaatacaaagggacctataagtggctattaaccaaccctacggagacagcccaaaccagatgcataaaaaatgaggatggaaatgccacaagattctgttcaatcagcatcaacacgggcaaatctcagtgggaaaagccaaagtttaaacaatgcaaattgcttcaagaacttcctgacaagattgtggatcttgctaatattaccataagtgatgagaatgctgaggatgttgcagagcatattttaaatttgataaatgaatccccagccctgggtaaagaagagacaaagattattgtttctaaaatatcagatatttcacaatgtgatgagataagtatgaacctaactcatgttatgttacaaataatcaacgttgttttggaaaagcaaaacaattccgcctctgatctgcatgaaataagcaatgaaattctgaggataattgagcgtactggtcacaagatggagttttctgggcagatagcaaatctgacggtggccgggctggctttggctgtgctgcggggggaccacacgtttgatggcatggctttcagcattcactcctatgaagaaggcacagaccctgagaccaaaaatgtcactaaagcattaaccacctatgttgtgagtgccagcatttcagatgatatgttcattcaaaacttagctgacccagtggttatcactctgcagcatattggaggaaaccagaattatggtcaagttcactgtgccttttgggattttgagaataataatgggctgggtggatggaattcgtcaggctgtaaagtaaaggaaacaaatgtaaattacacaatctgtcagtgtgaccacctcacccattttggagtcttaatggatttatccaggtctacagtggattcagtgaatgaacagatattagcgcttataacatacaccggatgtggaatctcctccatttttctgggagttgcagtggtgacatacatagcttttcacaaacttcgaaaagattatcctgccaaaattctgatcaacctgtgcacagcactactgatgctaaacctggtatttttgatcaattcttggttgtcatcatttcagaaagtgggagtttgtatcacagctgcagtggcacttcattacttcctgcttgtttcttttacttggatgggcctggaggcagtccacatgtatttggctctagtcaaagtcttcaacatatacattccaaattatatccttaaattttgtctagttggttggggaatcccggctatcatggtggcaatcacagtcagtgtgaaaaaagatctgtatggaactctgagcccaacaactccgttttgttggattaaagatgattctatcttttacatctcagtggtggcttatttttgcctcatatttctcatgaatctctccatgttctgcactgttcttgttcaactgaattctgtgaaatcccaaatccagaagactcggcggaagatgatcctgcatgacctcaaaggcacaatgagcctgacattcttacttggcctcacctgggggtttgcattttttgcttggggacccatgaggaactttttcttgtatttgtttgccatttttaacactttgcaagatgggagcagccggtgtcagataaaggttggatataaacaggagggactaaagaaaatctttgagcacaaactgttgacgccatctctcaagtcaactgcaactagctccactttcaaatctttaggctctgcacaaggcacaccttcagaaataagctttccaaatgctccagagctcagtgccctgcatgtggtggcttcagagcccactactggttga

SEQ ID NO: 2481 - DNA, 9820 bp, Homo sapiens
aggctgtgtgaccccacgttggggacaggtcacaaaacctaagccttgtgcctactggaaagaagaagcagtggagtccttgacagaagcagtggtgctggaacctggtgctaggcgctgggccaagcactttacatactgtgtgttatgtaatcttcacagcaatatgagacttagacaatgaaagaacacatcatatatcagaagctttatggattgattctcatgtcgagttttatctttctctcagatacactttcactaaaaggaaaaaagctggatttttttggaagaggtgacacatatgtaagcctgatagataccattcctgaactcagccgattcacagcatgcattgatctggtattcatggatgacaactcaaggtattggatggccttctcttatattactaataacgccctcctgggcagagaagacatagaccttggacttgcaggagaccatcagcagctaatactatacagattgggaaagaccttttctatccgtcaccacctggcttcatttcaatggcatacaatatgcttgatatgggatggtgtgaagggcaaattagaactcttcctgaataaagaaaggatactggaagtaacggatcaaccacacaacctgacacctcatgggactctgttcctagggcactttctcaagaatgagagcagcgaggttaaaagcatgatgcgtagctttcctggcagcttgtactactttcaactctgggaccacatcctggaaaacgaagagtttatgaagtgtttagatggaaatatagttagttgggaagaagacgtctggcttgtcaacaagatcatcccaactgttgacaggacactgcgctgctttgttcctgaaaatatgacaattcaagaaaaaagtacaactgtttcacaacagatagatatgaccactccatcccaaattactggagtaaaaccacaaaatactgcacattcctctacactattgtctcaaagcatacctatatttgcaactgattacacaaccatatcatattccaatacaacatctccacctctggaaacaatgactgcacaaaaaatcttaaagacactggtagatgagacagctacatttgcagtggatgttttatcaacttcatcagccatctctctgcctacccagagtatatccatagacaatactaccaattccatgaaaaaaacgaaatctccatcttcagaaagcacaaagacaacaaaaatggttgaagccatggctactgaaatctttcaaccacctacaccttctaatttcctatccacatccagatttaccaagaattcagttgtatctacaacttcagcaattaaatctcagtcggctgttacgaagacaacatctttattttcaactattgagtcaacatctatgtctacaacaccttgtctcaaacaaaaatccacaaatactggggcactccctatctccacagctggccaggagttcattgaatctacagctgccggaactgtaccttggtttacagtggaaaagacttcacctgcatctactcatgttgggactgcatcatcattcccacctgagcctgtgctcatctccacagctgctccagtagattctgtatttcctagaaaccagacagcatttccattggcaacaactgatatgaaaatagcatttacagtccattcattgactctcccaactaggcttattgagaccacacctgccccaaggacagctgaaacagaattgacatctacaaattttcaggatgtctctttacccagagtggaagatgccatgtctacttccatgtcgaaagagacctcctctaagaccttttctttcttaacatccttttcatttactgggactgagagtgtacagacagttattgatgctgaagctacacgtacagccttaactcctgaaatcacacttgcatctacagtggctgaaactatgctttcctccacaatcacaggacgagtttacacccagaatacacctacagctgatggacacttgcttactttgatgtccactagatcagcttccacatccaaggcacctgagtcaggtcccacatccacaactgatgaagctgcccatctgttctccagcaatgagaccatttggacttctaggccagaccaggccctgctggcatctatgaacacaaccaccatactcacatttgtgcctaatgaaaattttacatcagcatttcatgagaatactacttatacagaatatttatccgcaactaccaatatcaccccactgaaagcatctccagagggcaaaggtaccactgccaatgatgctactacagccagatatacaacagctgtatccaaattgacatcaccatggtttgctaatttctccatagtttctggaaccacatccataaccaatatgcctgaatttaaacttaccactttactactaaaaacaatacctatgtctacaaaacctgcaaatgaacttcctttgacaccaagggagactgttgttccatcagtagatataatatctactcttgcttgcattcaaccaaatttttctactgaggaaagtgcttctgagaccacacaaacagaaataaatggtgcaattgtatttggaggtacaacgacccctgtaccaaagtcagcaacaacacaaagattaaatgccactgtgacaagaaaagaagcaacttcccattatcttatgagaaaatcaactatagcagcagtggctgaggtttctccattttcaacaatgctggaagtgacagacgaatcagcacaaagggtgacagcttctgtcactgtttcctcttttcctgatatagaaaagctaagtaccccattggataataaaactgcaacaactgaggtgagagaaagttggcttttgacaaaattggtgaaaaccacacctaggagttcatacaatgaaatgacagaaatgtttaattttaaccacacctatgtagcacattggacttcagagacatctgagggaatttcagctggatctcccacttctgggagcacacatatattcggtgaacccctgggtgcttctaccacaaggatatcagaaaccagtttctccactacccctacagacaggacagctacgtccttgtctgatggtatcttacctccacagcctacagctgctcattcctcagcaacccctgtgcctgttactcatatgttctcattgccagttaatggcagttctgtggtggctgaggagactgaggttaccatgtctgagccttctacactggccagggctttttctacatctgtgctctcagatgtctcaaatctatcctcaactacaatgaccacagcattggtaccacctttggatcagactgcttccacaaccattgttattgtgcctacccatggagacttgattcgtaccacttcagaggccacggtaatctctgtcaggaagacatccatggcagttccttctctgacagaaacaccatttcattcactgagactctccactcctgtgacagctaaggctgagaccacccttttctctacctcagttgatacagtaaccccatctacacacactcttgtctgctcaaaacctccccctgacaacattcctcctgcgtcctccactcatgtgatctcaactacgtctacaccagaagcaactcaaccaatatctcaagtagaggagacttctacctatgctctcagcttcccatatactttcagtggtggtggagttgttgccagcttggctactggcaccacagagacctctgttgttgatgagaccacaccctcacacatctctgccaataagttgactacttcagtaaacagtcacatttcttcatctgccacatatcgtgtacacacaccagtgtccatccagttggtgactagcacctctgtcttatcttccgacaaagaccagatgaccatatccctgggaaaaacccctagaactatggaggtgacagaaatgtccccatcaaagaattcttttatttcatactcccggggtactccatctttggaaatgacagatacaggatttcctgagaccacaaaaatttccagtcaccaaacacattcgccttcagagattccacttgggactccctctgatggaaatttggcttcatctcccacttctggaagcacacagattacaccaaccttgacctcaagtaacacagtaggtgttcacattccagaaatgtctaccagtcttgggaaaacagctctcccctcacaagctctgacaatcaccacttttttgtgtcctgaaaaggaaagcacgagtgcccttccagcatatactcccaggactgtggaaatgatagtaaactccacctatgtgactcactctgtctcatatggccaggatacttcatttgtagataccacaacttccagctcaacaaggatatcaaatcctatggacatcaatacaactttttcacacttgcattcacttaggacacaacctgaggtgacttcagttgcctctttcatttctgaaagcacacagactttccctgagtccttgtctctttccacagctggactatataatgacggttttacagttctctccgacaggatcactacagccttttctgttccaaatgtacctacaatgcttcctagagaatcctctatggcaacgtccactcctatttaccagatgtcctcattgccagttaatgtaactgccttcacctccaaaaaagtttctgacactcccccaatagtgataactaaatcttctaaaacaatgcatccaggttgtttgaaaagtccctgtacagccacttctgggcctatgtctgagatgtcctcaataccagttaataactctgctttcacacctgcaacagtctcttctgacacttccacaagagttgggttattctctactttattgtcttcagttacccccaggactactatgaccatgcaaacatctacattggatgtcacacctgtgatatatgctggggctacttcaaaaaacaaaatggtttcctctgctttcactacagaaatgatagaggcaccttccaggatcacacctacgacctttctctctccaacagagccaactttgccctttgtaaaaaccgttcccaccaccattatggctgggatagtgactccatttgtaggcaccactgccttctctccactcagttctaagagcactggagctatttcctccattccaaagaccacattttcaccatttctatcagcaactcaacagtcatcacaagcagatgaggctacaactttgggcatattatctgggattactaacaggtccctatctactgtgaacagtggtacaggggtagctctcacagatacttattccagaatcactgttcctgaaaatatgctttcacctactcatgcagatagtctccatacttccttcaatattcaggtttccccatctctgactagctttaagagtgcttctggacccacaaaaaatgttaaaacaaccaccaattgcttttcttctaatactagaaagatgacttccttgttagaaaagacttccttaacaaactatgccacatctttgaatacccctgtttcataccctccatggaccccatccagtgcaactctaccctctttgacatcatttgtttattcacctcatagtactgaagctgagatctctactccaaagacctctcctcctcccacatcccaaatggttgaatttccagttctgggaacaagaatgacatctagtaatacccaacctctgcttatgacttcctggaacatacccacagctgaaggttctcagtttccaatttccaccactattaatgtacctacatccaatgagatggaaacagagactctacaccttgttcctgggcctttgtcaacattcacagcctctcagactggtctagtatctaaagatgtcatggcaatgtcatcaattcctatgtcaggaattcttcctaaccatgggctttctgagaacccttcattatcaacatctttaagagctatcacttccacattggctgacgttaagcacacatttgagaaaatgaccacatctgtaactcctgggaccacactcccatcaattctttctggtgccacttcaggatctgtaatttcaaagtcacccattctgacatggctcttatctagtctcccttctggctcccctccggcaactgtatctaatgcccctcatgttatgacttcctctacagtagaggtgtcaaaatcaacatttctgacatctgacatgatatcagcgcacccattcactaacttgacaacactaccctctgctactatgagcaccatactcacccgaaccattcctacacctacactgggtggtatcactactggcttcccaacttctctccctatgtctataaatgtcacagatgacattgtgtacatttccacacaccctgaggcatcctccagaaccacaataactgccaaccccaggactgtgtctcatccttcatccttcagcagaaagactatgtcaccttctacaactgaccacactctatctgttggtgccatgcctctgcctagctctacaataacatcttcatggaacagaattccaactgcatcatcaccctctactttaattattcctaagcccacactggactcccttctaaatataatgactactacatccactgttcctggagcctcatttccactcatatccactggggtgacatatccttttacagcaactgtgtcttcaccaatatcgtccttttttgaaacaacttggctggactccacaccttcctttctatctacggaagcatcgacttcgcctactgccaccaagtccacagtttccttctacaatgttgaaatgagcttctctgtctttgttgaagagccaaggatccctattaccagtgttataaatgaatttacggaaaattcgttgaattctatatttcagaacagtgaattttctcttgctactctggaaacccaaattaaaagcagggacatttcagaggaagagatggtcatggatcgagctattttggaacagagagaaggacaagaaatggctacaatttcctatgtaccatacagttgtgtttgtcaggtcatcataaaagccagctcttccttagcatcctctgaattgatgagaaaaatcaaaagtaaaatacatggcaacttcacacatggaaacttcacacaagatcaattgacgttattagtaaactgtgaacacgttgcagtgaaaaaactagagcctggaaattgcaaagctgatgaaacagcctctaaatacaaagggacctataagtggctattaaccaaccctacggagacagcccaaaccagatgcataaaaaatgaggatggaaatgccacaagattctgttcaatcagcatcaacacgggcaaatctcagtgggaaaagccaaagtttaaacaatgcaaattgcttcaagaacttcctgacaagattgtggatcttgctaatattaccataagtgatgagaatgctgaggatgttgcagagcatattttaaatttgataaatgaatccccagccctgggtaaagaagagacaaagattattgtttctaaaatatcagatatttcacaatgtgatgagataagtatgaacctaactcatgttatgttacaaataatcaacgttgttttggaaaagcaaaacaattccgcctctgatctgcatgaaataagcaatgaaattctgaggataattgagcgtactggtcacaagatggagttttctgggcagatagcaaatctgacggtggccgggctggctttggctgtgctgcggggggaccacacgtttgatggcatggctttcagcattcactcctatgaagaaggcacagaccctgagattttcctaggcaatgtccctgtgggagggattttggcttccatatatttgcctaaatcactgacggagagaattcctcttagcaacttacaaacgatcttgtttaatttctttggccaaacttcactctttaagaccaaaaatgtcactaaagcattaaccacctatgttgtgagtgccagcatttcagatgatatgttcattcaaaacttagctgacccagtggttatcactctgcagcatattggaggaaaccagaattatggtcaagttcactgtgccttttgggattttgagaataataatgggctgggtggatggaattcgtcaggctgtaaagtaaaggaaacaaatgtaaattacacaatctgtcagtgtgaccacctcacccattttggagtcttaatggatttatccaggtctacagtggattcagtgaatgaacagatattagcgcttataacatacaccggatgtggaatctcctccatttttctgggagttgcagtggtgacatacatagcttttcacaaacttcgaaaagattatcctgccaaaattctgatcaacctgtgcacagcactactgatgctaaacctggtatttttgatcaattcttggttgtcatcatttcagaaagtgggagtttgtatcacagctgcagtggcacttcattacttcctgcttgtttcttttacttggatgggcctggaggcagtccacatgtatttggctctagtcaaagtcttcaacatatacattccaaattatatccttaaattttgtctagttggttggggaatcccggctatcatggtggcaatcacagtcagtgtgaaaaaagatctgtatggaactctgagcccaacaactccgttttgttggattaaagatgattctatcttttacatctcagtggtggcttatttttgcctcatatttctcatgaatctctccatgttctgcactgttcttgttcaactgaattctgtgaaatcccaaatccagaagactcggcggaagatgatcctgcatgacctcaaaggcacaatgagcctgacattcttacttggcctcacctgggggtttgcattttttgcttggggacccatgaggaactttttcttgtatttgtttgccatttttaacactttgcaaggattcttcatttttgtgtttcactgtgtgatgaaggagagtgtgcgggagcagtggcagatacacctctgctgtgggtggttgcgattggataactcttctgatgggagcagccggtgtcagataaaggttggatataaacaggagggactaaagaaaatctttgagcacaaactgttgacgccatctctcaagtcaactgcaactagctccactttcaaatctttaggctctgcacaaggcacaccttcagaaataagctttccaaatgatgactttgacaaagatccttactgttcctctccttgatttgtgaagttgtgcctaattatgtaaaaagaatataatacctgtggaaataaaaatgaattccaagtgtatacttgctcgggtgatgggtgcaccaaaatctcacaaatcaccactaaataatgtactcatgtaaccaaatgctacctgttccaccaaaacctatggaaatttaaaaaaaacaaaaataaaaagcaaaacaaaaatcccaaaatgaattccattcacaaacagaatttttcaataaatcccagtagagatacttgcctcctcccaacccctgattggggaaaaggttgaatttgtgaaacaatctgctccaaccttctattttaattattattttgtaaggggaagaataacatttgataaatattaaagtcagaataattctcct

SEQ ID NO: 2482 - DNA, 9931 bp, Homo sapiens
cagtttcttaatccagtctatcactgatggacatttggatatggagagcagatggtcaacattctcctcataaccttccagggaatggaagatacccgttgaagccctcccaggctgtgtgaccccacgttggggacaggtcacaaaacctaagccttgtgcctactggaaagaagaagcagtggagtccttgacagaagcagtggtgctggaacctggtgctaggcgctgggccaagcactttacatactgtgtgttatgtaatcttcacagcaatatgagacttagacaatgaaagaacacatcatatatcagaagctttatggattgattctcatgtcgagttttatctttctctcagatacactttcactaaaaggaaaaaagctggatttttttggaagaggtgacacatatgtaagcctgatagataccattcctgaactcagccgattcacagcatgcattgatctggtattcatggatgacaactcaaggtattggatggccttctcttatattactaataacgccctcctgggcagagaagacatagaccttggacttgcaggagaccatcagcagctaatactatacagattgggaaagaccttttctatccgtcaccacctggcttcatttcaatggcatacaatatgcttgatatgggatggtgtgaagggcaaattagaactcttcctgaataaagaaaggatactggaagtaacggatcaaccacacaacctgacacctcatgggactctgttcctagggcactttctcaagaatgagagcagcgaggttaaaagcatgatgcgtagctttcctggcagcttgtactactttcaactctgggaccacatcctggaaaacgaagagtttatgaagtgtttagatggaaatatagttagttgggaagaagacgtctggcttgtcaacaagatcatcccaactgttgacaggacactgcgctgctttgttcctgaaaatatgacaattcaagaaaaaagtacaactgtttcacaacagatagatatgaccactccatcccaaattactggagtaaaaccacaaaatactgcacattcctctacactattgtctcaaagcatacctatatttgcaactgattacacaaccatatcatattccaatacaacatctccacctctggaaacaatgactgcacaaaaaatcttaaagacactggtagatgagacagctacatttgcagtggatgttttatcaacttcatcagccatctctctgcctacccagagtatatccatagacaatactaccaattccatgaaaaaaacgaaatctccatcttcagaaagcacaaagacaacaaaaatggttgaagccatggctactgaaatctttcaaccacctacaccttctaatttcctatccacatccagatttaccaagaattcagttgtatctacaacttcagcaattaaatctcagtcggctgttacgaagacaacatctttattttcaactattgagtcaacatctatgtctacaacaccttgtctcaaacaaaaatccacaaatactggggcactccctatctccacagctggccaggagttcattgaatctacagctgccggaactgtaccttggtttacagtggaaaagacttcacctgcatctactcatgttgggactgcatcatcattcccacctgagcctgtgctcatctccacagctgctccagtagattctgtatttcctagaaaccagacagcatttccattggcaacaactgatatgaaaatagcatttacagtccattcattgactctcccaactaggcttattgagaccacacctgccccaaggacagctgaaacagaattgacatctacaaattttcaggatgtctctttacccagagtggaagatgccatgtctacttccatgtcgaaagagacctcctctaagaccttttctttcttaacatccttttcatttactgggactgagagtgtacagacagttattgatgctgaagctacacgtacagccttaactcctgaaatcacacttgcatctacagtggctgaaactatgctttcctccacaatcacaggacgagtttacacccagaatacacctacagctgatggacacttgcttactttgatgtccactagatcagcttccacatccaaggcacctgagtcaggtcccacatccacaactgatgaagctgcccatctgttctccagcaatgagaccatttggacttctaggccagaccaggccctgctggcatctatgaacacaaccaccatactcacatttgtgcctaatgaaaattttacatcagcatttcatgagaatactacttatacagaatatttatccgcaactaccaatatcaccccactgaaagcatctccagagggcaaaggtaccactgccaatgatgctactacagccagatatacaacagctgtatccaaattgacatcaccatggtttgctaatttctccatagtttctggaaccacatccataaccaatatgcctgaatttaaacttaccactttactactaaaaacaatacctatgtctacaaaacctgcaaatgaacttcctttgacaccaagggagactgttgttccatcagtagatataatatctactcttgcttgcattcaaccaaatttttctactgaggaaagtgcttctgagaccacacaaacagaaataaatggtgcaattgtatttggaggtacaacgacccctgtaccaaagtcagcaacaacacaaagattaaatgccactgtgacaagaaaagaagcaacttcccattatcttatgagaaaatcaactatagcagcagtggctgaggtttctccattttcaacaatgctggaagtgacagacgaatcagcacaaagggtgacagcttctgtcactgtttcctcttttcctgatatagaaaagctaagtaccccattggataataaaactgcaacaactgaggtgagagaaagttggcttttgacaaaattggtgaaaaccacacctaggagttcatacaatgaaatgacagaaatgtttaattttaaccacacctatgtagcacattggacttcagagacatctgagggaatttcagctggatctcccacttctgggagcacacatatattcggtgaacccctgggtgcttctaccacaaggatatcagaaaccagtttctccactacccctacagacaggacagctacgtccttgtctgatggtatcttacctccacagcctacagctgctcattcctcagcaacccctgtgcctgttactcatatgttctcattgccagttaatggcagttctgtggtggctgaggagactgaggttaccatgtctgagccttctacactggccagggctttttctacatctgtgctctcagatgtctcaaatctatcctcaactacaatgaccacagcattggtaccacctttggatcagactgcttccacaaccattgttattgtgcctacccatggagacttgattcgtaccacttcagaggccacggtaatctctgtcaggaagacatccatggcagttccttctctgacagaaacaccatttcattcactgagactctccactcctgtgacagctaaggctgagaccacccttttctctacctcagttgatacagtaaccccatctacacacactcttgtctgctcaaaacctccccctgacaacattcctcctgcgtcctccactcatgtgatctcaactacgtctacaccagaagcaactcaaccaatatctcaagtagaggagacttctacctatgctctcagcttcccatatactttcagtggtggtggagttgttgccagcttggctactggcaccacagagacctctgttgttgatgagaccacaccctcacacatctctgccaataagttgactacttcagtaaacagtcacatttcttcatctgccacatatcgtgtacacacaccagtgtccatccagttggtgactagcacctctgtcttatcttccgacaaagaccagatgaccatatccctgggaaaaacccctagaactatggaggtgacagaaatgtccccatcaaagaattcttttatttcatactcccggggtactccatctttggaaatgacagatacaggatttcctgagaccacaaaaatttccagtcaccaaacacattcgccttcagagattccacttgggactccctctgatggaaatttggcttcatctcccacttctggaagcacacagattacaccaaccttgacctcaagtaacacagtaggtgttcacattccagaaatgtctaccagtcttgggaaaacagctctcccctcacaagctctgacaatcaccacttttttgtgtcctgaaaaggaaagcacgagtgcccttccagcatatactcccaggactgtggaaatgatagtaaactccacctatgtgactcactctgtctcatatggccaggatacttcatttgtagataccacaacttccagctcaacaaggatatcaaatcctatggacatcaatacaactttttcacacttgcattcacttaggacacaacctgaggtgacttcagttgcctctttcatttctgaaagcacacagactttccctgagtccttgtctctttccacagctggactatataatgacggttttacagttctctccgacaggatcactacagccttttctgttccaaatgtacctacaatgcttcctagagaatcctctatggcaacgtccactcctatttaccagatgtcctcattgccagttaatgtaactgccttcacctccaaaaaagtttctgacactcccccaatagtgataactaaatcttctaaaacaatgcatccaggttgtttgaaaagtccctgtacagccacttctgggcctatgtctgagatgtcctcaataccagttaataactctgctttcacacctgcaacagtctcttctgacacttccacaagagttgggttattctctactttattgtcttcagttacccccaggactactatgaccatgcaaacatctacattggatgtcacacctgtgatatatgctggggctacttcaaaaaacaaaatggtttcctctgctttcactacagaaatgatagaggcaccttccaggatcacacctacgacctttctctctccaacagagccaactttgccctttgtaaaaaccgttcccaccaccattatggctgggatagtgactccatttgtaggcaccactgccttctctccactcagttctaagagcactggagctatttcctccattccaaagaccacattttcaccatttctatcagcaactcaacagtcatcacaagcagatgaggctacaactttgggcatattatctgggattactaacaggtccctatctactgtgaacagtggtacaggggtagctctcacagatacttattccagaatcactgttcctgaaaatatgctttcacctactcatgcagatagtctccatacttccttcaatattcaggtttccccatctctgactagctttaagagtgcttctggacccacaaaaaatgttaaaacaaccaccaattgcttttcttctaatactagaaagatgacttccttgttagaaaagacttccttaacaaactatgccacatctttgaatacccctgtttcataccctccatggaccccatccagtgcaactctaccctctttgacatcatttgtttattcacctcatagtactgaagctgagatctctactccaaagacctctcctcctcccacatcccaaatggttgaatttccagttctgggaacaagaatgacatctagtaatacccaacctctgcttatgacttcctggaacatacccacagctgaaggttctcagtttccaatttccaccactattaatgtacctacatccaatgagatggaaacagagactctacaccttgttcctgggcctttgtcaacattcacagcctctcagactggtctagtatctaaagatgtcatggcaatgtcatcaattcctatgtcaggaattcttcctaaccatgggctttctgagaacccttcattatcaacatctttaagagctatcacttccacattggctgacgttaagcacacatttgagaaaatgaccacatctgtaactcctgggaccacactcccatcaattctttctggtgccacttcaggatctgtaatttcaaagtcacccattctgacatggctcttatctagtctcccttctggctcccctccggcaactgtatctaatgcccctcatgttatgacttcctctacagtagaggtgtcaaaatcaacatttctgacatctgacatgatatcagcgcacccattcactaacttgacaacactaccctctgctactatgagcaccatactcacccgaaccattcctacacctacactgggtggtatcactactggcttcccaacttctctccctatgtctataaatgtcacagatgacattgtgtacatttccacacaccctgaggcatcctccagaaccacaataactgccaaccccaggactgtgtctcatccttcatccttcagcagaaagactatgtcaccttctacaactgaccacactctatctgttggtgccatgcctctgcctagctctacaataacatcttcatggaacagaattccaactgcatcatcaccctctactttaattattcctaagcccacactggactcccttctaaatataatgactactacatccactgttcctggagcctcatttccactcatatccactggggtgacatatccttttacagcaactgtgtcttcaccaatatcgtccttttttgaaacaacttggctggactccacaccttcctttctatctacggaagcatcgacttcgcctactgccaccaagtccacagtttccttctacaatgttgaaatgagcttctctgtctttgttgaagagccaaggatccctattaccagtgttataaatgaatttacggaaaattcgttgaattctatatttcagaacagtgaattttctcttgctactctggaaacccaaattaaaagcagggacatttcagaggaagagatggtcatggatcgagctattttggaacagagagaaggacaagaaatggctacaatttcctatgtaccatacagttgtgtttgtcaggtcatcataaaagccagctcttccttagcatcctctgaattgatgagaaaaatcaaaagtaaaatacatggcaacttcacacatggaaacttcacacaagatcaattgacgttattagtaaactgtgaacacgttgcagtgaaaaaactagagcctggaaattgcaaagctgatgaaacagcctctaaatacaaagggacctataagtggctattaaccaaccctacggagacagcccaaaccagatgcataaaaaatgaggatggaaatgccacaagattctgttcaatcagcatcaacacgggcaaatctcagtgggaaaagccaaagtttaaacaatgcaaattgcttcaagaacttcctgacaagattgtggatcttgctaatattaccataagtgatgagaatgctgaggatgttgcagagcatattttaaatttgataaatgaatccccagccctgggtaaagaagagacaaagattattgtttctaaaatatcagatatttcacaatgtgatgagataagtatgaacctaactcatgttatgttacaaataatcaacgttgttttggaaaagcaaaacaattccgcctctgatctgcatgaaataagcaatgaaattctgaggataattgagcgtactggtcacaagatggagttttctgggcagatagcaaatctgacggtggccgggctggctttggctgtgctgcggggggaccacacgtttgatggcatggctttcagcattcactcctatgaagaaggcacagaccctgagattttcctaggcaatgtccctgtgggagggattttggcttccatatatttgcctaaatcactgacggagagaattcctcttagcaacttacaaacgatcttgtttaatttctttggccaaacttcactctttaagaccaaaaatgtcactaaagcattaaccacctatgttgtgagtgccagcatttcagatgatatgttcattcaaaacttagctgacccagtggttatcactctgcagcatattggaggaaaccagaattatggtcaagttcactgtgccttttgggattttgagaataataatgggctgggtggatggaattcgtcaggctgtaaagtaaaggaaacaaatgtaaattacacaatctgtcagtgtgaccacctcacccattttggagtcttaatggatttatccaggtctacagtggattcagtgaatgaacagatattagcgcttataacatacaccggatgtggaatctcctccatttttctgggagttgcagtggtgacatacatagcttttcacaaacttcgaaaagattatcctgccaaaattctgatcaacctgtgcacagcactactgatgctaaacctggtatttttgatcaattcttggttgtcatcatttcagaaagtgggagtttgtatcacagctgcagtggcacttcattacttcctgcttgtttcttttacttggatgggcctggaggcagtccacatgtatttggctctagtcaaagtcttcaacatatacattccaaattatatccttaaattttgtctagttggttggggaatcccggctatcatggtggcaatcacagtcagtgtgaaaaaagatctgtatggaactctgagcccaacaactccgttttgttggattaaagatgattctatcttttacatctcagtggtggcttatttttgcctcatatttctcatgaatctctccatgttctgcactgttcttgttcaactgaattctgtgaaatcccaaatccagaagactcggcggaagatgatcctgcatgacctcaaaggcacaatgagcctgacattcttacttggcctcacctgggggtttgcattttttgcttggggacccatgaggaactttttcttgtatttgtttgccatttttaacactttgcaaggattcttcatttttgtgtttcactgtgtgatgaaggagagtgtgcgggagcagtggcagatacacctctgctgtgggtggttgcgattggataactcttctgatgggagcagccggtgtcagataaaggttggatataaacaggagggactaaagaaaatctttgagcacaaactgttgacgccatctctcaagtcaactgcaactagctccactttcaaatctttaggctctgcacaaggcacaccttcagaaataagctttccaaatgatgactttgacaaagatccttactgttcctctccttgatttgtgaagttgtgcctaattatgtaaaaagaatataatacctgtggaaataaaaatgaattccaagtgtatacttgctcgggtgatgggtgcaccaaaatctcacaaatcaccactaaataatgtactcatgtaaccaaatgctacctgttccaccaaaacctatggaaatttaaaaaaaacaaaaataaaaagcaaaacaaaaatcccaaaatgaattccattcacaaacagaatttttcaataaatcccagtagagatacttgcctcctcccaacccctgattggggaaaaggttgaatttgtgaaacaatctgctccaaccttctattttaattattattttgtaaggggaagaataacatttgataaatattaaagtcagaataattctcct

SEQ ID NO: 2483 - DNA, 9205 bp, Homo sapiens
aggctgtgtgaccccacgttggggacaggtcacaaaacctaagccttgtgcctactggaaagaagaagcagtggagtccttgacagaagcagtggtgctggaacctggtgctaggcgctgggccaagcactttacatactgtgtgttatgtaatcttcacagcaatatgagacttagacaatgaaagaacacatcatatatcagaagctttatggattgattctcatgtcgagttttatctttctctcagttgttcctgaaaatatgacaattcaagaaaaaagtacaactgtttcacaacagatagatatgaccactccatcccaaattactggagtaaaaccacaaaatactgcacattcctctacactattgtctcaaagcatacctatatttgcaactgattacacaaccatatcatattccaatacaacatctccacctctggaaacaatgactgcacaaaaaatcttaaagacactggtagatgagacagctacatttgcagtggatgttttatcaacttcatcagccatctctctgcctacccagagtatatccatagacaatactaccaattccatgaaaaaaacgaaatctccatcttcagaaagcacaaagacaacaaaaatggttgaagccatggctactgaaatctttcaaccacctacaccttctaatttcctatccacatccagatttaccaagaattcagttgtatctacaacttcagcaattaaatctcagtcggctgttacgaagacaacatctttattttcaactattgagtcaacatctatgtctacaacaccttgtctcaaacaaaaatccacaaatactggggcactccctatctccacagctggccaggagttcattgaatctacagctgccggaactgtaccttggtttacagtggaaaagacttcacctgcatctactcatgttgggactgcatcatcattcccacctgagcctgtgctcatctccacagctgctccagtagattctgtatttcctagaaaccagacagcatttccattggcaacaactgatatgaaaatagcatttacagtccattcattgactctcccaactaggcttattgagaccacacctgccccaaggacagctgaaacagaattgacatctacaaattttcaggatgtctctttacccagagtggaagatgccatgtctacttccatgtcgaaagagacctcctctaagaccttttctttcttaacatccttttcatttactgggactgagagtgtacagacagttattgatgctgaagctacacgtacagccttaactcctgaaatcacacttgcatctacagtggctgaaactatgctttcctccacaatcacaggacgagtttacacccagaatacacctacagctgatggacacttgcttactttgatgtccactagatcagcttccacatccaaggcacctgagtcaggtcccacatccacaactgatgaagctgcccatctgttctccagcaatgagaccatttggacttctaggccagaccaggccctgctggcatctatgaacacaaccaccatactcacatttgtgcctaatgaaaattttacatcagcatttcatgagaatactacttatacagaatatttatccgcaactaccaatatcaccccactgaaagcatctccagagggcaaaggtaccactgccaatgatgctactacagccagatatacaacagctgtatccaaattgacatcaccatggtttgctaatttctccatagtttctggaaccacatccataaccaatatgcctgaatttaaacttaccactttactactaaaaacaatacctatgtctacaaaacctgcaaatgaacttcctttgacaccaagggagactgttgttccatcagtagatataatatctactcttgcttgcattcaaccaaatttttctactgaggaaagtgcttctgagaccacacaaacagaaataaatggtgcaattgtatttggaggtacaacgacccctgtaccaaagtcagcaacaacacaaagattaaatgccactgtgacaagaaaagaagcaacttcccattatcttatgagaaaatcaactatagcagcagtggctgaggtttctccattttcaacaatgctggaagtgacagacgaatcagcacaaagggtgacagcttctgtcactgtttcctcttttcctgatatagaaaagctaagtaccccattggataataaaactgcaacaactgaggtgagagaaagttggcttttgacaaaattggtgaaaaccacacctaggagttcatacaatgaaatgacagaaatgtttaattttaaccacacctatgtagcacattggacttcagagacatctgagggaatttcagctggatctcccacttctgggagcacacatatattcggtgaacccctgggtgcttctaccacaaggatatcagaaaccagtttctccactacccctacagacaggacagctacgtccttgtctgatggtatcttacctccacagcctacagctgctcattcctcagcaacccctgtgcctgttactcatatgttctcattgccagttaatggcagttctgtggtggctgaggagactgaggttaccatgtctgagccttctacactggccagggctttttctacatctgtgctctcagatgtctcaaatctatcctcaactacaatgaccacagcattggtaccacctttggatcagactgcttccacaaccattgttattgtgcctacccatggagacttgattcgtaccacttcagaggccacggtaatctctgtcaggaagacatccatggcagttccttctctgacagaaacaccatttcattcactgagactctccactcctgtgacagctaaggctgagaccacccttttctctacctcagttgatacagtaaccccatctacacacactcttgtctgctcaaaacctccccctgacaacattcctcctgcgtcctccactcatgtgatctcaactacgtctacaccagaagcaactcaaccaatatctcaagtagaggagacttctacctatgctctcagcttcccatatactttcagtggtggtggagttgttgccagcttggctactggcaccacagagacctctgttgttgatgagaccacaccctcacacatctctgccaataagttgactacttcagtaaacagtcacatttcttcatctgccacatatcgtgtacacacaccagtgtccatccagttggtgactagcacctctgtcttatcttccgacaaagaccagatgaccatatccctgggaaaaacccctagaactatggaggtgacagaaatgtccccatcaaagaattcttttatttcatactcccggggtactccatctttggaaatgacagatacaggatttcctgagaccacaaaaatttccagtcaccaaacacattcgccttcagagattccacttgggactccctctgatggaaatttggcttcatctcccacttctggaagcacacagattacaccaaccttgacctcaagtaacacagtaggtgttcacattccagaaatgtctaccagtcttgggaaaacagctctcccctcacaagctctgacaatcaccacttttttgtgtcctgaaaaggaaagcacgagtgcccttccagcatatactcccaggactgtggaaatgatagtaaactccacctatgtgactcactctgtctcatatggccaggatacttcatttgtagataccacaacttccagctcaacaaggatatcaaatcctatggacatcaatacaactttttcacacttgcattcacttaggacacaacctgaggtgacttcagttgcctctttcatttctgaaagcacacagactttccctgagtccttgtctctttccacagctggactatataatgacggttttacagttctctccgacaggatcactacagccttttctgttccaaatgtacctacaatgcttcctagagaatcctctatggcaacgtccactcctatttaccagatgtcctcattgccagttaatgtaactgccttcacctccaaaaaagtttctgacactcccccaatagtgataactaaatcttctaaaacaatgcatccaggttgtttgaaaagtccctgtacagccacttctgggcctatgtctgagatgtcctcaataccagttaataactctgctttcacacctgcaacagtctcttctgacacttccacaagagttgggttattctctactttattgtcttcagttacccccaggactactatgaccatgcaaacatctacattggatgtcacacctgtgatatatgctggggctacttcaaaaaacaaaatggtttcctctgctttcactacagaaatgatagaggcaccttccaggatcacacctacgacctttctctctccaacagagccaactttgccctttgtaaaaaccgttcccaccaccattatggctgggatagtgactccatttgtaggcaccactgccttctctccactcagttctaagagcactggagctatttcctccattccaaagaccacattttcaccatttctatcagcaactcaacagtcatcacaagcagatgaggctacaactttgggcatattatctgggattactaacaggtccctatctactgtgaacagtggtacaggggtagctctcacagatacttattccagaatcactgttcctgaaaatatgctttcacctactcatgcagatagtctccatacttccttcaatattcaggtttccccatctctgactagctttaagagtgcttctggacccacaaaaaatgttaaaacaaccaccaattgcttttcttctaatactagaaagatgacttccttgttagaaaagacttccttaacaaactatgccacatctttgaatacccctgtttcataccctccatggaccccatccagtgcaactctaccctctttgacatcatttgtttattcacctcatagtactgaagctgagatctctactccaaagacctctcctcctcccacatcccaaatggttgaatttccagttctgggaacaagaatgacatctagtaatacccaacctctgcttatgacttcctggaacatacccacagctgaaggttctcagtttccaatttccaccactattaatgtacctacatccaatgagatggaaacagagactctacaccttgttcctgggcctttgtcaacattcacagcctctcagactggtctagtatctaaagatgtcatggcaatgtcatcaattcctatgtcaggaattcttcctaaccatgggctttctgagaacccttcattatcaacatctttaagagctatcacttccacattggctgacgttaagcacacatttgagaaaatgaccacatctgtaactcctgggaccacactcccatcaattctttctggtgccacttcaggatctgtaatttcaaagtcacccattctgacatggctcttatctagtctcccttctggctcccctccggcaactgtatctaatgcccctcatgttatgacttcctctacagtagaggtgtcaaaatcaacatttctgacatctgacatgatatcagcgcacccattcactaacttgacaacactaccctctgctactatgagcaccatactcacccgaaccattcctacacctacactgggtggtatcactactggcttcccaacttctctccctatgtctataaatgtcacagatgacattgtgtacatttccacacaccctgaggcatcctccagaaccacaataactgccaaccccaggactgtgtctcatccttcatccttcagcagaaagactatgtcaccttctacaactgaccacactctatctgttggtgccatgcctctgcctagctctacaataacatcttcatggaacagaattccaactgcatcatcaccctctactttaattattcctaagcccacactggactcccttctaaatataatgactactacatccactgttcctggagcctcatttccactcatatccactggggtgacatatccttttacagcaactgtgtcttcaccaatatcgtccttttttgaaacaacttggctggactccacaccttcctttctatctacggaagcatcgacttcgcctactgccaccaagtccacagtttccttctacaatgttgaaatgagcttctctgtctttgttgaagagccaaggatccctattaccagtgttataaatgaatttacggaaaattcgttgaattctatatttcagaacagtgaattttctcttgctactctggaaacccaaattaaaagcagggacatttcagaggaagagatggtcatggatcgagctattttggaacagagagaaggacaagaaatggctacaatttcctatgtaccatacagttgtgtttgtcaggtcatcataaaagccagctcttccttagcatcctctgaattgatgagaaaaatcaaaagtaaaatacatggcaacttcacacatggaaacttcacacaagatcaattgacgttattagtaaactgtgaacacgttgcagtgaaaaaactagagcctggaaattgcaaagctgatgaaacagcctctaaatacaaagggacctataagtggctattaaccaaccctacggagacagcccaaaccagatgcataaaaaatgaggatggaaatgccacaagattctgttcaatcagcatcaacacgggcaaatctcagtgggaaaagccaaagtttaaacaatgcaaattgcttcaagaacttcctgacaagattgtggatcttgctaatattaccataagtgatgagaatgctgaggatgttgcagagcatattttaaatttgataaatgaatccccagccctgggtaaagaagagacaaagattattgtttctaaaatatcagatatttcacaatgtgatgagataagtatgaacctaactcatgttatgttacaaataatcaacgttgttttggaaaagcaaaacaattccgcctctgatctgcatgaaataagcaatgaaattctgaggataattgagcgtactggtcacaagatggagttttctgggcagatagcaaatctgacggtggccgggctggctttggctgtgctgcggggggaccacacgtttgatggcatggctttcagcattcactcctatgaagaaggcacagaccctgagattttcctaggcaatgtccctgtgggagggattttggcttccatatatttgcctaaatcactgacggagagaattcctcttagcaacttacaaacgatcttgtttaatttctttggccaaacttcactctttaagaccaaaaatgtcactaaagcattaaccacctatgttgtgagtgccagcatttcagatgatatgttcattcaaaacttagctgacccagtggttatcactctgcagcatattggaggaaaccagaattatggtcaagttcactgtgccttttgggattttgagaataataatgggctgggtggatggaattcgtcaggctgtaaagtaaaggaaacaaatgtaaattacacaatctgtcagtgtgaccacctcacccattttggagtcttaatggatttatccaggtctacagtggattcagtgaatgaacagatattagcgcttataacatacaccggatgtggaatctcctccatttttctgggagttgcagtggtgacatacatagcttttcacaaacttcgaaaagattatcctgccaaaattctgatcaacctgtgcacagcactactgatgctaaacctggtatttttgatcaattcttggttgtcatcatttcagaaagtgggagtttgtatcacagctgcagtggcacttcattacttcctgcttgtttcttttacttggatgggcctggaggcagtccacatgtatttggctctagtcaaagtcttcaacatatacattccaaattatatccttaaattttgtctagttggttggggaatcccggctatcatggtggcaatcacagtcagtgtgaaaaaagatctgtatggaactctgagcccaacaactccgttttgttggattaaagatgattctatcttttacatctcagtggtggcttatttttgcctcatatttctcatgaatctctccatgttctgcactgttcttgttcaactgaattctgtgaaatcccaaatccagaagactcggcggaagatgatcctgcatgacctcaaaggcacaatgagcctgacattcttacttggcctcacctgggggtttgcattttttgcttggggacccatgaggaactttttcttgtatttgtttgccatttttaacactttgcaaggattcttcatttttgtgtttcactgtgtgatgaaggagagtgtgcgggagcagtggcagatacacctctgctgtgggtggttgcgattggataactcttctgatgggagcagccggtgtcagataaaggttggatataaacaggagggactaaagaaaatctttgagcacaaactgttgacgccatctctcaagtcaactgcaactagctccactttcaaatctttaggctctgcacaaggcacaccttcagaaataagctttccaaatgatgactttgacaaagatccttactgttcctctccttgatttgtgaagttgtgcctaattatgtaaaaagaatataatacctgtggaaataaaaatgaattccaagtgtatacttgctcgggtgatgggtgcaccaaaatctcacaaatcaccactaaataatgtactcatgtaaccaaatgctacctgttccaccaaaacctatggaaatttaaaaaaaacaaaaataaaaagcaaaacaaaaatcccaaaatgaattccattcacaaacagaatttttcaataaatcccagtagagatacttgcctcctcccaacccctgattggggaaaaggttgaatttgtgaaacaatctgctccaaccttctattttaattattattttgtaaggggaagaataacatttgataaatattaaagtcagaataattctcct

SEQ ID NO: 2484 - DNA, 3240 bp, Homo sapiens
atggtctgttcggctgccccactgctgctcctggccacaactcttcccctgctggggtcaccagttgcccaagcatcccaacctgtaagtgagactggggtgagacccagggaaggtctgcagaggcgacaatggggacccctgattgggagagacaaagcatggaatgaaaggatagacagacccttccctgcctgccccatccccctatcttctagctttggccgatggcccaagggccagacaatgtgggcccagacctccaccctcaccctgacagaggaggagttgggacagagtcaggctggaggggaatctggatctgggcagctcctggaccaagagaatggagcaggggaatcagcgctggtctccgtctatgtacatctggactttccagataagacctggccccctgaactctccaggacactgactctccctgctgcctcagcttcctcttccccaaggcctcttctcactggcctcagactcacaacagagtgtaatgtcaaccacaaggggaatttctattgtgcttgcctctctggctaccagtggaacaccagcatctgcctccattaccctccttgtcaaagcctccacaaccaccagccttgtggctgccttgtcttcagccatcccgaacccgggtactgccagttgctgccacctgggtcccctgtcacctgcctccctgcagtccccgggatcctcaacctgaactcccagctgcagatgcctggtgacacgctgagcctgactctccatctgagccaggaggccaccaacctgagctggttcctgaggcacccagggagccccagtcccatcctcctgcagccagggacacaggtgtctgtgacttccagccacggccaggctgccctcagcgtctccaacatgtcccatcactgggcaggtgagtacatgagctgcttcgaggcccagggcttcaagtggaacctgtatgaggtggtgagggtgcccttgaaggcgacagatgtggctcgacttccataccagctgtccatctcctgtgccacctcccctggcttccagctgagctgctgcatccccagcacaaacctggcctacaccgcggcctggagccctggagagggcagcaaagcttcctccttcaacgagtcaggctctcagtgctttgtgctggctgttcagcgctgcccgatggctgacaccacgtacgcttgtgacctgcagagcctgggcctggctccactcagggtccccatctccatcaccatcatccaggatggagacatcacctgccctgaggacgcctcggtgctcacctggaatgtcaccaaggctggccacgtggcacaggccccatgtcctgagagcaagaggggcatagtgaggaggctctgtggggctgacggagtctgggggccggtccacagcagctgcacagatgcgaggctcctggccttgttcactagaaccaagctgctgcaggcaggccagggcagtcctgctgaggaggtgccacagatcctggcacagctgccagggcaggcggcagaggcaagttcaccctccgacttactgaccctgctgagcaccatgaaatacgtggccaaggtggtggcagaggccagaatacagcttgaccgcagagccctgaagaatctcctgattgccacagacaaggtcctagatatggacaccaggtctctgtggaccctggcccaagcccggaagccctgggcaggctcgactctcctgctggctgtggagaccctggcatgcagcctgtgcccacaggaccaccccttcgccttcagcttacccaatgtgctgctgcagagccagctgtttggacccacgtttcctgctgactacagcatctccttccctactcggcccccactgcaggctcagattcccaggcactcactggccccattggtccgtaatggaactgaaataagtattactagcctggtgctgcgaaaactggaccaccttctgccctcaaactatggacaagggctgggggattccctctatgccactcctggcctggtccttgtcatttccatcatggcaggtgaccgggccttcagccagggagaggtcatcatggactttgggaacacagatggttcccctcactgtgtcttctgggatcacagtctcttccagggcagggggggttggtccaaagaagggtgccaggcacaggtggccagtgccagccccactgctcagtgcctctgccagcacctcactgccttctccgtcctcatgtccccacacactgttccggaagaacccgctctggcgctgctgactcaagtgggcttgggagcttccatactggcgctgcttgtgtgcctgggtgtgtactggctggtgtggagagtcgtggtgcggaacaagatctcctatttccgccacgccgccctgctcaacatggtgttctgcttgctggccgcagacacttgcttcctgggcgccccattcctctctccagggccccgaagcccgctctgccttgctgccgccttcctctgtcatttcctctacctggccacctttttctggatgctggcgcaggccctggtgttggcccaccagctgctctttgtctttcaccagctggcaaagcaccgagttctccccctcatggtgctcctgggctacctgtgcccactggggttggcaggtgtcaccctggggctctacctacctcaagggcaatacctgagggagggggaatgctggttggatgggaagggaggggcgttatacaccttcgtggggccagtgctggccatcataggcgtgaatgggctggtactagccatggccatgctgaagttgctgagaccttcgctgtcagagggacccccagcagagaagcgccaagctctgctgggggtgatcaaagccctgctcattcttacacccatctttggcctcacctgggggctgggcctggccactctgttagaggaagtctccacggtccctcattacatcttcaccattctcaacaccctccagggcgtcttcatcctattgtttggttgcctcatggacaggaagatacaagaagctttgcgcaaacgcttctgccgcgcccaagcccccagctccaccatctccctggtgagttgctgccttcagatcctcagctgtgcatccaagagcatgtcagaaggcattccatggccctcctcagaggacatgggcacagccagaagctga

SEQ ID NO: 2485 - DNA, 3896 bp, Homo sapiens
ctccctttcatctggtggccctagcgccacaagctgccgcttaggaagtccctgccgggagcagaagtggagacatcagcaggatggcatcggcaagtcgctcccctcccgggcctcatctgccaaacgatcatctcctcctccgaagttgtatgcatgacaggcgagtggaaacttcactaaaatgaaggcgattgacacaacagaaggaactccatcctttcgggggcttacgaaaataataagtttaaaaaaaataggaagggaattccctcgctccatgatcactgagcgctctcctaaggaaaaggaaatctcccggggggtgccgactacgggcggcgggcttaggatgctcccacgctccccgacccccaatccccaggacccgcaggacctccggaggaacgcccgccagcccgcccggagccacgcggcacaaggtgacacggaccgcgccgcgcgggcccctcagccgcctgggcgaggccgggagcagggagaggggcatccgccggcccgcggtaccttgtacttatcaaagccagccagctgctccgggctcacgtattcgtagccagccatgacgacccgaaaactgagcgcccactcggcagcgactcccggctacaaggctgtgacacacaagcaccacaccggctgggcaaggatggcaaagactgggctgcccgagaagggacagagtcaggctggaggggaatctggatctgggcagctcctggaccaagagaatggagcaggggaatcagcgctggtctccgtctatgtacatctggactttccagataagacctggccccctgaactctccaggacactgactctccctgctgcctcagcttcctcttccccaaggcctcttctcactggcctcagactcacaacaggtgagtacatgagctgcttcgaggcccagggcttcaagtggaacctgtatgaggtggtgagggtgcccttgaaggcgacagatgtggctcgacttccataccagctgtccatctcctgtgccacctcccctggcttccagctgagctgctgcatccccagcacaaacctggcctacaccgcggcctggagccctggagagggcagcaaagcttcctccttcaacgagtcaggctctcagtgctttgtgctggctgttcagcgctgcccgatggctgacaccacgtacgcttgtgacctgcagagcctgggcctggctccactcagggtccccatctccatcaccatcatccaggatggagacatcacctgccctgaggacgcctcggtgctcacctggaatgtcaccaaggctggccacgtggcacaggccccatgtcctgagagcaagaggggcatagtgaggaggctctgtggggctgacggagtctgggggccggtccacagcagctgcacagatgcgaggctcctggccttgttcactagaaccaagctgctgcaggcaggccagggcagtcctgctgaggaggtgccacagatcctggcacagctgccagggcaggcggcagaggcaagttcaccctccgacttactgaccctgctgagcaccatgaaatacgtggccaaggtggtggcagaggccagaatacagcttgaccgcagagccctgaagaatctcctgattgccacagacaaggtcctagatatggacaccaggtctctgtggaccctggcccaagcccggaagccctgggcaggctcgactctcctgctggctgtggagaccctggcatgcagcctgtgcccacaggaccaccccttcgccttcagcttacccaatgtgctgctgcagagccagctgtttggacccacgtttcctgctgactacagcatctccttccctactcggcccccactgcaggctcagattcccaggcactcactggccccattggtccgtaatggaactgaaataagtattactagcctggtgctgcgaaaactggaccaccttctgccctcaaactatggacaagggctgggggattccctctatgccactcctggcctggtccttgtcatttccatcatggcaggtgaccgggccttcagccagggagaggtcatcatggactttgggaacacagatggttcccctcactgtgtcttctgggatcacagtctcttccagggcagggggggttggtccaaagaagggtgccaggcacaggtggccagtgccagccccactgctcagtgcctctgccagcacctcactgccttctccgtcctcatgtccccacacactgttccggaagaacccgctctggcgctgctgactcaagtgggcttgggagcttccatactggcgctgcttgtgtgcctgggtgtgtactggctggtgtggagagtcgtggtgcggaacaagatctcctatttccgccacgccgccctgctcaacatggtgttctgcttgctggccgcagacacttgcttcctgggcgccccattcctctctccagggccccgaagcccgctctgccttgctgccgccttcctctgtcatttcctctacctggccacctttttctggatgctggcgcaggccctggtgttggcccaccagctgctctttgtctttcaccagctggcaaagcaccgagttctccccctcatggtgctcctgggctacctgtgcccactggggttggcaggtgtcaccctggggctctacctacctcaagggcaatacctgagggagggggaatgctggttggatgggaagggaggggcgttatacaccttcgtggggccagtgctggccatcataggcgtgaatgggctggtactagccatggccatgctgaagttgctgagaccttcgctgtcagagggacccccagcagagaagcgccaagctctgctgggggtgatcaaagccctgctcattcttacacccatctttggcctcacctgggggctgggcctggccactctgttagaggaagtctccacggtccctcattacatcttcaccattctcaacaccctccagggcgtcttcatcctattgtttggttgcctcatggacaggaagatacaagaagctttgcgcaaacgcttctgccgcgcccaagcccccagctccaccatctccctggccacaaatgaaggctgcatcttggaacacagcaaaggaggaagcgacactgccaggaagacagatgcttcagagtgaaccacacacggacccatgttcctgcaagggagttgaggctgtgtgcttgaacccaccagatgagccctggcccaatgctctgaactcttcccgcctcccggagctcagcccttgagaaaggcaggcttatatttcccttagtgacactcatttatcttacagctcaccccttctcatttctaaagtatccagcaagaatagcaggaaaaattagctaaaggcacctaatgaataagcctgcctttgctccagaaataatcgacagatatcaaagtgcggaataattacaagtaaactttctcaaccagtttttaactacaacaatacatgttgtgaatgaatatatttgataaaaatggttttaattgacctattcagcgatttctgattatttctttttcaatagttatgaagaaaggatgacttacttgacaggaacctctgatctttcaaacattggagatgaagggcagaatttggtttgtcttttcaagtttaggaaaaggtgaagttaattggtccctctttctttaacctttaaaaaatcaatataaaatgtaagtttcttaaccatatccatgtatagaggcattgattgatatgagcacgttgtaagaataggttataaaaatttaaagtttaatataaatttatatcaattaataaagtttaatttatatttaaaaatgaa

SEQ ID NO: 2486 - DNA, 3620 bp, Homo sapiens
atcagcaggatggcatcggcaagtcgctcccctcccgggcctcatctgccaaacgatcatctcctcctccgaagttgtatgcatgacaggcgagtggaaacttcactaaaatgaaggcgattgacacaacagaaggaactccatcctttcgggggcttacgaaaataataagtttaaaaaaaataggaagggaattccctcgctccatgatcactgagcgctctcctaaggaaaaggaaatctcccggggggtgccgactacgggcggcgggcttaggatgctcccacgctccccgacccccaatccccaggacccgcaggacctccggaggaacgcccgccagcccgcccggagccacgcggcacaaggtgacacggaccgcgccgcgcgggcccctcagccgcctgggcgaggccgggagcagggagaggggcatccgccggcccgcggtaccttgtacttatcaaagccagccagctgctccgggctcacgtattcgtagccagccatgacgacccgaaaactgagcgcccactcggcagcgactcccggctacaaggctgtgacacacaagcaccacaccggctgggcaaggatggcaaagactgggctgcccgagaagcttcctccttcaacgagtcaggctctcagtgctttgtgctggctgttcagcgctgcccgatggctgacaccacgtacgcttgtgacctgcagagcctgggcctggctccactcagggtccccatctccatcaccatcatccaggatggagacatcacctgccctgaggacgcctcggtgctcacctggaatgtcaccaaggctggccacgtggcacaggccccatgtcctgagagcaagaggggcatagtgaggaggctctgtggggctgacggagtctgggggccggtccacagcagctgcacagatgcgaggctcctggccttgttcactagaaccaagctgctgcaggcaggccagggcagtcctgctgaggaggtgccacagatcctggcacagctgccagggcaggcggcagaggcaagttcaccctccgacttactgaccctgctgagcaccatgaaatacgtggccaaggtggtggcagaggccagaatacagcttgaccgcagagccctgaagaatctcctgattgccacagacaaggtcctagatatggacaccaggtctctgtggaccctggcccaagcccggaagccctgggcaggctcgactctcctgctggctgtggagaccctggcatgcagcctgtgcccacaggaccaccccttcgccttcagcttacccaatgtgctgctgcagagccagctgtttggacccacgtttcctgctgactacagcatctccttccctactcggcccccactgcaggctcagattcccaggcactcactggccccattggtccgtaatggaactgaaataagtattactagcctggtgctgcgaaaactggaccaccttctgccctcaaactatggacaagggctgggggattccctctatgccactcctggcctggtccttgtcatttccatcatggcaggtgaccgggccttcagccagggagaggtcatcatggactttgggaacacagatggttcccctcactgtgtcttctgggatcacagtctcttccagggcagggggggttggtccaaagaagggtgccaggcacaggtggccagtgccagccccactgctcagtgcctctgccagcacctcactgccttctccgtcctcatgtccccacacactgttccggaagaacccgctctggcgctgctgactcaagtgggcttgggagcttccatactggcgctgcttgtgtgcctgggtgtgtactggctggtgtggagagtcgtggtgcggaacaagatctcctatttccgccacgccgccctgctcaacatggtgttctgcttgctggccgcagacacttgcttcctgggcgccccattcctctctccagggccccgaagcccgctctgccttgctgccgccttcctctgtcatttcctctacctggccacctttttctggatgctggcgcaggccctggtgttggcccaccagctgctctttgtctttcaccagctggcaaagcaccgagttctccccctcatggtgctcctgggctacctgtgcccactggggttggcaggtgtcaccctggggctctacctacctcaagggcaatacctgagggagggggaatgctggttggatgggaagggaggggcgttatacaccttcgtggggccagtgctggccatcataggcgtgaatgggctggtactagccatggccatgctgaagttgctgagaccttcgctgtcagagggacccccagcagagaagcgccaagctctgctgggggtgatcaaagccctgctcattcttacacccatctttggcctcacctgggggctgggcctggccactctgttagaggaagtctccacggtccctcattacatcttcaccattctcaacaccctccagggcgtcttcatcctattgtttggttgcctcatggacaggaagatacaagaagctttgcgcaaacgcttctgccgcgcccaagcccccagctccaccatctccctggccacaaatgaaggctgcatcttggaacacagcaaaggaggaagcgacactgccaggaagacagatgcttcagagtgaaccacacacggacccatgttcctgcaagggagttgaggctgtgtgcttgaacccaccagatgagccctggcccaatgctctgaactcttcccgcctcccggagctcagcccttgagaaaggcaggcttatatttcccttagtgacactcatttatcttacagctcaccccttctcatttctaaagtatccagcaagaatagcaggaaaaattagctaaaggcacctaatgaataagcctgcctttgctccagaaataatcgacagatatcaaagtgcggaataattacaagtaaactttctcaaccagtttttaactacaacaatacatgttgtgaatgaatatatttgataaaaatggttttaattgacctattcagcgatttctgattatttctttttcaatagttatgaagaaaggatgacttacttgacaggaacctctgatctttcaaacattggagatgaagggcagaatttggtttgtcttttcaagtttaggaaaaggtgaagttaattggtccctctttctttaacctttaaaaaatcaatataaaatgtaagtttcttaaccatatccatgtatagaggcattgattgatatgagcacgttgtaagaataggttataaaaatttaaagtttaatataaatttatatcaattaataaagtttaatttatatttaaaaatgaatactagaagaaaatctttttgaagacaccaagatatctatctggctgaattaacttatggaattcacaagaggaagatgacaggattctgagaaatttttaaactagatacgtgaaaaaagtctgatgaatcggtctttgttaattatgcaattcatggatattttttataaaatgggacgggggcattttctgttaaaataaaaatggttatgctatc

SEQ ID NO: 2487 - DNA, 3353 bp, Homo sapiens
tcttccttgcggaaatttgcatcgtgggcttgtagggactgcttcactgagccatggtctgttcggctgccccactgctgctcctggccacaactcttcccctgctggggtcaccagttgcccaagcatcccaacctggacagagtcaggctggaggggaatctggatctgggcagctcctggaccaagagaatggagcaggggaatcagcgctggtctccgtctatgtacatctggactttccagataagacctggccccctgaactctccaggacactgactctccctgctgcctcagcttcctcttccccaaggcctcttctcactggcctcagactcacaacagagtgtaatgtcaaccacaaggggaatttctattgtgcttgcctctctggctaccagtggaacaccagcatctgcctccattaccctccttgtcaaagcctccacaaccaccagccttgtggctgccttgtcttcagccatcccgaacccgggtactgccagttgctgccacctgggtcccctgtcacctgcctccctgcagtccccgggatcctcaacctgaactcccagctgcagatgcctggtgacacgctgagcctgactctccatctgagccaggaggccaccaacctgagctggttcctgaggcacccagggagccccagtcccatcctcctgcagccagggacacaggtgtctgtgacttccagccacggccaggctgccctcagcgtctccaacatgtcccatcactgggcaggtgagtacatgagctgcttcgaggcccagggcttcaagtggaacctgtatgaggtggtgagggtgcccttgaaggcgacagatgtggctcgacttccataccagctgtccatctcctgtgccacctcccctggcttccagctgagctgctgcatccccagcacaaacctggcctacaccgcggcctggagccctggagagggcagcaaagcttcctccttcaacgagtcaggctctcagtgctttgtgctggctgttcagcgctgcccgatggctgacaccacgtacgcttgtgacctgcagagcctgggcctggctccactcagggtccccatctccatcaccatcatccaggatggagacatcacctgccctgaggacgcctcggtgctcacctggaatgtcaccaaggctggccacgtggcacaggccccatgtcctgagagcaagaggggcatagtgaggaggctctgtggggctgacggagtctgggggccggtccacagcagctgcacagatgcgaggctcctggccttgttcactagaaccaagctgctgcaggcaggccagggcagtcctgctgaggaggtgccacagatcctggcacagctgccagggcaggcggcagaggcaagttcaccctccgacttactgaccctgctgagcaccatgaaatacgtggccaaggtggtggcagaggccagaatacagcttgaccgcagagccctgaagaatctcctgattgccacagacaaggtcctagatatggacaccaggtctctgtggaccctggcccaagcccggaagccctgggcaggctcgactctcctgctggctgtggagaccctggcatgcagcctgtgcccacaggaccaccccttcgccttcagcttacccaatgtgctgctgcagagccagctgtttggacccacgtttcctgctgactacagcatctccttccctactcggcccccactgcaggctcagattcccaggcactcactggccccattggtccgtaatggaactgaaataagtattactagcctggtgctgcgaaaactggaccaccttctgccctcaaactatggacaagggctgggggattccctctatgccactcctggcctggtccttgtcatttccatcatggcaggtgaccgggccttcagccagggagaggtcatcatggactttgggaacacagatggttcccctcactgtgtcttctgggatcacagtctcttccagggcagggggggttggtccaaagaagggtgccaggcacaggtggccagtgccagccccactgctcagtgcctctgccagcacctcactgccttctccgtcctcatgtccccacacactgttccggaagaacccgctctggcgctgctgactcaagtgggcttgggagcttccatactggcgctgcttgtgtgcctgggtgtgtactggctggtgtggagagtcgtggtgcggaacaagatctcctatttccgccacgccgccctgctcaacatggtgttctgcttgctggccgcagacacttgcttcctgggcgccccattcctctctccagggccccgaagcccgctctgccttgctgccgccttcctctgtcatttcctctacctggccacctttttctggatgctggcgcaggccctggtgttggcccaccagctgctctttgtctttcaccagctggcaaagcaccgagttctccccctcatggtgctcctgggctacctgtgcccactggggttggcaggtgtcaccctggggctctacctacctcaagggcaatacctgagggagggggaatgctggttggatgggaagggaggggcgttatacaccttcgtggggccagtgctggccatcataggcgtgaatgggctggtactagccatggccatgctgaagttgctgagaccttcgctgtcagagggacccccagcagagaagcgccaagctctgctgggggtgatcaaagccctgctcattcttacacccatctttggcctcacctgggggctgggcctggccactctgttagaggaagtctccacggtccctcattacatcttcaccattctcaacaccctccagggcgtcttcatcctattgtttggttgcctcatggacaggaagatacaagaagctttgcgcaaacgcttctgccgcgcccaagcccccagctccaccatctccctggccacaaatgaaggctgcatcttggaacacagcaaaggaggaagcgacactgccaggtgagaactaggctttctcaggggcagcgtaagcagggtggattgaggacggtgtggcaaagggcctcctggcaaagtgctggagagaagcctcctctttctatacccagcccacaccaaagggtaggaaacaggtttttctagggtagccattgctagatggctgggagacggtggaaatgtcagagagcagaaagcatagcaccttatcttgctttccaagaaagcaagaagtttcaccaccaccagtccttgacttggtttctctgaaaattccttttcacattatcacacatttaattatcatgag

SEQ ID NO: 2488 - DNA, 3767 bp, Homo sapiens
ggcagcttctcaggtcagcctcctccgggcctctccccactctcctctgcccagttctctgtccttatccacaggcccctcagtgggcactggccatacccatgtccaggtgggcacagacctggtgatatcctggtgagcaagctggggacccaccctccttccctttctggttggcagctccacatctggggcaatgtagagatctgtgcttttggaaggaggggcaatttaaattaagaagtggttaggcatgggtctcgaatcttagcttccccgcgaggtctgggacaagtgaagagaggtttcttttctggacctcagtttctcatctgtaaaatggggtgagtctgggaacctgcaccttggatggctgtcaggggctcagtagaggacctggcacacagtttgtgcttggcaatctggagcaggtgcagctcctttcagagtgacctggattggatcctggggacagcatgtctcagggccggagccagttcttggaggagactctgcacagggcatggatcactgtggtgcccttttcctgtgcctgtgccttctgactttgcagaatgcaacaacagagacatgggaagaactcctgagctacatggagaatatgcaggtgtccaggggccggagctcagttttttcctctcgtcaactccaccagctggagcagatgctactgaacaccagcttcccaggctacaacctgaccttgcagacacccaccatccagtctctggccttcaagctgagctgtgacttctctggcctctcgctgaccagtgccactctgaagcgggtgccccaggcaggaggtcagcatgcccggggtcagcacgccatgcagttccccgccgagctgacccgggacgcctgcaagacccgccccagggagctgcggctcatctgtatctacttctccaacacccactttttcaaggatgaaaacaactcatctctgctgaataactacgtcctgggggcccagctgagtcatgggcacgtgaacaacctcagggatcctgtgaacatcagcttctggcacaaccaaagcctggaaggctacaccctgacctgtgtcttctggaaggagggagccaggaaacagccctgggggggctggagccctgagggctgtcgtacagagcagccctcccactctcaggtgctctgccgctgcaaccacctcacctactttgctgttctcatgcaactctccccagccctggtccctgcagagttgctggcacctcttacgtacatctccctcgtgggctgcagcatctccatcgtggcctcgctgatcacagtcctgctgcacttccatttcaggaagcagagtgactccttaacacgcatccacatgaacctgcatgcctccgtgctgctcctgaacatcgccttcctgctgagccccgcattcgcaatgtctcctgtgcccgggtcagcatgcacggctctggccgctgccctgcactacgcgctgctcagctgcctcacctggatggccatcgagggcttcaacctctacctcctcctcgggcgtgtctacaacatctacatccgcagatatgtgttcaagcttggtgtgctaggctggggggccccagccctcctggtgctgctttccctctctgtcaagagctcggtatacggaccctgcacaatccccgtcttcgacagctgggagaatggcacaggcttccagaacatgtccatatgctgggtgcggagccccgtggtgcacagtgtcctggtcatgggctacggcggcctcacgtccctcttcaacctggtggtgctggcctgggcgctgtggaccctgcgcaggctgcgggagcgggcggatgcaccaagtgtcagggcctgccatgacactgtcactgtgctgggcctcaccgtgctgctgggaaccacctgggccttggccttcttttcttttggcgtcttcctgctgccccagctgttcctcttcaccatcttaaactcgctctacggtttcttccttttcctgtggttctgctcccagcggtgccgctcagaagcagaggccaaggcacagatagaggccttcagctcctcccaaacaacacagtagtccgggcctcctggcctggaatcctcagcctctctggccgccagtagcctgaggctacggctcctgctagagagggtggcaggcctgctgctggaccccagaggccactgtgaccgccaaggggccttttccacttccacggcctctccaggcactgaggggaaggcattgctctacctctccctgacattttgctccggggcagatccaaccttacctggggcagcaaactttgtcctggtacctgggcccagctcgccagggatgtgggcagagcaccagcctgggcatcaggaagccaagtttcaaggactgtctttgagtctgtctgtatgaccttgggcctgccacttctcacagaccctaggtatccacagctgtgacatgggggcaagcggctttgtttcagcctaacccaggagcttagtaaaaattgcataagaccagggggaagagtgtcagcgtggggtgggaattcccgcggcctccacctgcttgctaggggcaggatctcattcaggctgccctggaagcacctgcttggccctgccaccttcctccaggggagggccagatggcatcctggcttggggcgggtgggacctacccaggctctgagactttactggcctatgcctgaggcctcttttcctttaactccctaaattatgatgactccaagtccaagcccacccttcccaaagattgggaggttccgccgttcccagaggctcctcctgcggtgctcccaagacttccatagaccatctggaccagtagcccatcccgcagttttcttgggggcagaggaaaacgcttctttctcctccagctgaatcagctggatcccagtgtcctggctgtttggtgattgggcaagattgaatttgcccaggtaggcgtgagagtgtgggttttaaattcgaagctcaggccatagtttcagagaatcacccttaccccagaccttcatgagacagtgctcatgaagccagtgcgtttcccagaacgaacactaggcggcaccgttggtccacactcagaggcccttggcgccaagactgcatctagaatcgctcaaacacctgtttgcagaccccatgcaccagctggaggggccgtaactgcaggactgcgcctactgagtgacccatttcctccaggaggaaaggcaagacacgcttacacggccatttgtctcttttcccaatgcggcggtgcactttcgctcttgggggctgcaccccagacatagctggcaccagagcagggtgctcaggtggtgggtgctcagggccctgccccaggccactgggccgttttgatgacctcgaaggtcacaggcagaaaataggagcaggatttcccctggggaaaagttctcctgggacatcttctgctcttctgtacatttctagatgcaaataactccttcaccaggcagtgagtggcgtaggctctggagccaggctgcctgggctccaatgccagctctgccacttgctagctgtgagactgtggacaaaccactcagcctctgtgtgcctcagttttcctatttgtaaaatagaggccatagtggtacctattttgaagactaagtaaaagaattcaaataaagagacttggcacagagtaagtgctcagtaaatggtta

SEQ ID NO: 2489 - DNA, 1713 bp, Homo sapiens
atggatcactgtggtgcccttttcctgtgcctgtgccttctgactttgcagaatgcaacaacagagacatgggaagaactcctgagctacatggagaatatgcaggtgtccaggggccggagctcagttttttcctctcgtcaactccaccagctggagcagatgctactgaacaccagcttcccaggctacaacctgaccttgcagacacccaccatccagtctctggccttcaagctgagctgtgacttctctggcctctcgctgaccagtgccactctgaagcgggtgccccaggcaggaggtcagcatgcccggggtcagcacgccatgcagttccccgccgagctgacccgggacgcctgcaagacccgccccagggagctgcggctcatctgtatctacttctccaacacccactttttcaaggatgaaaacaactcatctctgctgaataactacgtcctgggggcccagctgagtcatgggcacgtgaacaacctcagggatcctgtgaacatcagcttctggcacaaccaaagcctggaaggctacaccctgacctgtgtcttctggaaggagggagccaggaaacagccctgggggggctggagccctgagggctgtcgtacagagcagccctcccactctcaggtgctctgccgctgcaaccacctcacctactttgctgttctcatgcaactctccccagccctggtccctgcagagttgctggcacctcttacgtacatctccctcgtgggctgcagcatctccatcgtggcctcgctgatcacagtcctgctgcacttccatttcaggaagcagagtgactccttaacacgcatccacatgaacctgcatgcctccgtgctgctcctgaacatcgccttcctgctgagccccgcattcgcaatgtctcctgtgcccgggtcagcatgcacggctctggccgctgccctgcactacgcgctgctcagctgcctcacctggatggccatcgagggcttcaacctctacctcctcctcgggcgtgtctacaacatctacatccgcagatatgtgttcaagcttggtgtgctaggctggggggccccagccctcctggtgctgctttccctctctgtcaagagctcggtatacggaccctgcacaatccccgtcttcgacagctgggagaatggcacaggcttccagaacatgtccatatgctgggtgcggagccccgtggtgcacagtgtcctggtcatgggctacggcggcctcacgtccctcttcaacctggtggtgctggcctgggcgctgtggaccctgcgcaggctgcgggagcgggcggatgcaccaagtgtcagggcctgccatgacactgtcactgtgctgggcctcaccgtgctgctgggaaccacctgggccttggccttcttttcttttggcgtcttcctgctgccccagctgttcctcttcaccatcttaaactcgctctacggcaaaggagggggcactgtttctaagaagagtgatgataccaccgtatttttgaaaaatgatgaaacagcgtgggggaaactgctatgtcttccatattcaggctttttcttctccaagcccatttcctccctagcaatgataagaggaaacactcccgcgcctgtgggtggcgatgacatccctgccatctatgaggtggagcatttccaacaagagcaggtctga

SEQ ID NO: 2490 - DNA, 1672 bp, Homo sapiens
ttcctgcagaagctacaagacagcagccgagacagcagctgagacggcagcggcagcttctcagggccggagccagttcttggaggagactctgcacagggcatggatcactgtggtgcccttttcctgtgcctgtgccttctgactttgcagaatgcaacaacagagacatgggaagaactcctgagctacatggagaatatgcaggtgtccaggggccggagctcagttttttcctctcgtcaactccaccagctggagcagatgctactgaacaccagcttcccaggctacaacctgaccttgcagacacccaccatccagtctctggccttcaagctgagctgtgacttctctggcctctcgctgaccagtgccactctgaagcgggtgccccaggcaggaggtcagcatgcccggggtcagcacgccatgcagttccccgccgagctgacccgggacgcctgcaagacccgccccagggagctgcggctcatctgtatctacttctccaacacccactttttcaaggatgaaaacaactcatctctgctgaataactacgtcctgggggcccagctgagtcatgggcacgtgaacaacctcagggatcctgtgaacatcagcttctggcacaaccaaagcctggaaggctacaccctgacctgtgtcttctggaaggagggagccaggaaacagccctgggggggctggagccctgagggctgtcgtacagagcagccctcccactctcaggtgctctgccgctgcaaccacctcacctactttgctgttctcatgcaactctccccagccctggtccctgcagagttgctggcacctcttacgtacatctccctcgtgggctgcagcatctccatcgtggcctcgctgatcacagtcctgctgcacttccatttcaggaagcagagtgactccttaacacgcatccacatgaacctgcatgcctccgtgctgctcctgaacatcgccttcctgctgagccccgcattcgcaatgtctcctgtgcccgggtcagcatgcacggctctggccgctgccctgcactacgcgctgctcagctgcctcacctggatggccatcgagggcttcaacctctacctcctcctcgggcgtgtctacaacatctacatccgcagatatgtgttcaagcttggtgtgctaggctgggatgctgggtgcggagccccgtggtgcacagtgtcctggtcatgggctacggcggcctcacgtccctcttcaacctggtggtgctggcctgggcgctgtggaccctgcgcaggctgcgggagcgggcggatgcaccaagtgtcagggcctgccatgacactgtcactgtgctgggcctcaccgtgctgctgggaaccacctgggccttggccttcttttcttttggcgtcttcctgctgccccagctgttcctcttcaccatcttaaactcgctctacggtttcttccttttcctgtggttctgctcccagcggtgccgctcagaagcagaggccaaggcacagatagaggccttcagctcctcccaaacaacacagtagtccgggcctcctggcctggaatcctcagcctctctggccgccagtagcctgaggctacggctcctgctagagagggtggcaggcctgctgctggaccccag

SEQ ID NO: 2491 - DNA, 5641 bp, Homo sapiens
agagaacagaaggcagttcacctctgctcccgacagcctgggaacccgcaagagccccagcatttgaagtctggtcttgtgaaaccccaccctcctctggctgtgtgattgaatgggatgccctcgaggttcacctcacctgagagggttttgggcagatcagcagtaaggtgttaaattttagaagcctgaaaactccagaagagaaagatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattaccgacattttgagcataaatgtgacaacagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggactacaactcctttcaagcagttactatcaatgaaagcaatttctttgtcacaccagaaatcatctttgaaggggacacagtcagtctggtgtgtgaaaaggaagttttgtcctccaatgtgtcttggcgctatgaagaacagcagttggaaatccagaacagcagcagattctcgatttacaccgcacttttcaacaacatgacttcggtgtccaagctcaccatccacaacatcactccaggtgatgcaggtgaatatgtttgcaaactgatattagacatttttgaatatgagtgcaagaagaaaatagatgttatgcccatccaaattttggcaaatgaagaaatgaaggtgatgtgcgacaacaatcctgtatctttgaactgctgcagtcagggtaatgttaattggagcaaagtagaatggaagcaggaaggaaaaataaatattccaggaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatacgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtctggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcgggagatagccctcctttgtccttctcccaaactaatgtgcagatgagcagcatggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgcccaggatatccaggaaaataactttgcagagagcttagtgatgacaaccactgtcagccacaatacaactatgccattcaggatttcaatgacttttaagaacaatagcccttcaggcggcgaaacgaagtgtgtcttctggaacttcaggcttgccaacaacacaggggggtgggacagcagtgggtgctatgtagaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaaccggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaagaaaggaaggaaagaagggagggaaacagggagaaagggaaaaagaagaaaaagagaaagatgaaaataggaacaaataaagacaaacaacattaagggccatattgtaagatttccatgttaatgatctaatataatcactcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattacaaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatg

SEQ ID NO: 2492 - DNA, 5810 bp, Homo sapiens
actttttgtttttaaaacagcagcgcggctctcagggatgactctgtgagactgggaggatcatagctgggggaggctgagcgtgggagcggtgctgccagtcctgcctgaaaacgcgaaatgagtcttgcttggttctccctccactgggcgtgagagcccctgcccaggaggcccaggacaaatggccccatagtggaaactgggaagcttttaggcatctgatcagagcgggagccagccgggggaccacagtgctggacaggccaaccaactcaaacttgaagacatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattaccgacattttgagcataaatgtgacaacagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggactacaactcctttcaagcagttactatcaatgaaagcaatttctttgtcacaccagaaatcatctttgaaggggacacagtcagtctggtgtgtgaaaaggaagttttgtcctccaatgtgtcttggcgctatgaagaacagcagttggaaatccagaacagcagcagattctcgatttacaccgcacttttcaacaacatgacttcggtgtccaagctcaccatccacaacatcactccaggtgatgcaggtgaatatgtttgcaaactgatattagacatttttgaatatgagtgcaagaagaaaatagatgttatgcccatccaaattttggcaaatgaagaaatgaaggtgatgtgcgacaacaatcctgtatctttgaactgctgcagtcagggtaatgttaattggagcaaagtagaatggaagcaggaaggaaaaataaatattccaggaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatacgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtctggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcgggagatagccctcctttgtccttctcccaaactaatgtgcagatgagcagcatggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgcccaggatatccaggaaaataactttgcagagagcttagtgatgacaaccactgtcagccacaatacaactatgccattcaggatttcaatgacttttaagaacaatagcccttcaggcggcgaaacgaagtgtgtcttctggaacttcaggcttgccaacaacacaggggggtgggacagcagtgggtgctatgtagaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaaccggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaagaaaggaaggaaagaagggagggaaacagggagaaagggaaaaagaagaaaaagagaaagatgaaaataggaacaaataaagacaaacaacattaagggccatattgtaagatttccatgttaatgatctaatataatcactcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattacaaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatgaaaattgcacgcatattagagttaaccatgtactattgatacagcaacgctacattgcaaataaaagtccgatcccaaaaggagaatgag

SEQ ID NO: 2493 - DNA, 5750 bp, Homo sapiens
actttttgtttttaaaacagcagcgcggctctcagggatgactctgtgagactgggaggatcatagctgggggaggctgagcgtgggagcggtgctgccagtcctgcctgaaaacgcgaaatgagtcttgcttggttctccctccactgggcgtgagagcccctgcccaggaggcccaggacaaatggccccatagtggaaactgggaagcttttaggcatctgatcagagcgggagccagccgggggaccacagtgctggacaggccaaccaactcaaacttgaagacatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattaccgacattttgagcataaatgtgacaacagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggactacaactcctttcaagcagttactatcaatgaaagcaatttctttgtcacaccagaaatcatctttgaaggggacacagtcagtctggtgtgtgaaaaggaagttttgtcctccaatgtgtcttggcgctatgaagaacagcagttggaaatccagaacagcagcagattctcgatttacaccgcacttttcaacaacatgacttcggtgtccaagctcaccatccacaacatcactccaggtgatgcaggtgaatatgtttgcaaactgatattagacatttttgaatatgagtgcaagaagaaaatagatgttatgcccatccaaattttggcaaatgaagaaatgaaggtgatgtgcgacaacaatcctgtatctttgaactgctgcagtcagggtaatgttaattggagcaaagtagaatggaagcaggaaggaaaaataaatattccaggaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatacgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtctggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcgggagatagccctcctttgtccttctcccaaactaatgtgcagatgagcagcatggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgcccaggatatccaggaaaataactttgcagagagcttagtgatgacaaccactgtcagccacaatacaactatgccattcaggatttcaatgacttttaagaacaatagcccttcaggcggcgaaacgaagtgtgtcttctggaacttcaggcttgccaacaacacaggggggtgggacagcagtgggtgctatgtagaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaaccggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaagaaaggaaggaaagaagggagggaaacagggagaaagggaaaaagaagaaaaagagaaagatgaaaataggaacaaataaagacaaacaacattaagggccatattgtaagatttccatgttaatgatctaatataatcactcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattacaaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatgaaaattgcacgcatattagagttaaccatgtactattgatacagcaacgctacattgcaaataaaagtccgatcccaaaaggagaatgag

SEQ ID NO: 2494 - DNA, 5750 bp, Homo sapiens
acagaaggcagttcacctctgctcccgacagcctgggaacccgcaagagccccagcatttgaagtctggtcttgtgaaaccccaccctcctctggctgtgtgattgaatgggatgccctcgaggttcacctcacctgagagggttttgggcagatcagcagtaaggtgttaaattttagaagcctgaaaactccagaagagaaaggccaaccaactcaaacttgaagacatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattaccgacattttgagcataaatgtgacaacagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggactacaactcctttcaagcagttactatcaatgaaagcaatttctttgtcacaccagaaatcatctttgaaggggacacagtcagtctggtgtgtgaaaaggaagttttgtcctccaatgtgtcttggcgctatgaagaacagcagttggaaatccagaacagcagcagattctcgatttacaccgcacttttcaacaacatgacttcggtgtccaagctcaccatccacaacatcactccaggtgatgcaggtgaatatgtttgcaaactgatattagacatttttgaatatgagtgcaagaagaaaatagatgttatgcccatccaaattttggcaaatgaagaaatgaaggtgatgtgcgacaacaatcctgtatctttgaactgctgcagtcagggtaatgttaattggagcaaagtagaatggaagcaggaaggaaaaataaatattccaggaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatacgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtctggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcgggagatagccctcctttgtccttctcccaaactaatgtgcagatgagcagcatggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgcccaggatatccaggaaaataactttgcagagagcttagtgatgacaaccactgtcagccacaatacaactatgccattcaggatttcaatgacttttaagaacaatagcccttcaggcggcgaaacgaagtgtgtcttctggaacttcaggcttgccaacaacacaggggggtgggacagcagtgggtgctatgtagaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaaccggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaagaaaggaaggaaagaagggagggaaacagggagaaagggaaaaagaagaaaaagagaaagatgaaaataggaacaaataaagacaaacaacattaagggccatattgtaagatttccatgttaatgatctaatataatcactcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattacaaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatgaaaattgcacgcatattagagttaaccatgtactattgatacagcaacgctacattgcaaataaaagtccgatcccaaaaggagaatgag

SEQ ID NO: 2495 - DNA, 5384 bp, Homo sapiens
actttttgtttttaaaacagcagcgcggctctcagggatgactctgtgagactgggaggatcatagctgggggaggctgagcgtgggagcggtgctgccagtcctgcctgaaaacgcgaaatgagtcttgcttggttctccctccactgggcgtgagagcccctgcccaggaggcccaggacaaatggccccatagtggaaactgggaagcttttaggcatctgatcagagcgggagccagccgggggaccacagtgctggacaggccaaccaactcaaacttgaagacatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattaccgacattttgagcataaatgtgacaacagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggactacaactcctttcaagcagttactatcagaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatacgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtctggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcgggagatagccctcctttgtccttctcccaaactaatgtgcagatgagcagcatggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgcccaggatatccaggaaaataactttgcagagagcttagtgatgacaaccactgtcagccacaatacaactatgccattcaggatttcaatgacttttaagaacaatagcccttcaggcggcgaaacgaagtgtgtcttctggaacttcaggcttgccaacaacacaggggggtgggacagcagtgggtgctatgtagaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaaccggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaagaaaggaaggaaagaagggagggaaacagggagaaagggaaaaagaagaaaaagagaaagatgaaaataggaacaaataaagacaaacaacattaagggccatattgtaagatttccatgttaatgatctaatataatcactcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattacaaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatgaaaattgcacgcatattagagttaaccatgtactattgatacagcaacgctacattgcaaataaaagtccgatcccaaaaggagaatgag

SEQ ID NO: 2496 - DNA, 3634 bp, Homo sapiens
gattacagaagtcaggttcatgtggaaagcagagaggggctttggaaaatcaagggcaaaattaagaaattgggtagttctgaaaaggtgacggaaagtaaaggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcgggagatagccctcctttgtccttctcccaaactaatgtgcagatgagcagcatggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgcccaggatatccaggaaaataactttgcagagagcttagtgatgacaaccactgtcagccacaatacaactatgccattcaggatttcaatgacttttaagaacaatagcccttcaggcggcgaaacgaagtgtgtcttctggaacttcaggcttgccaacaacacaggggggtgggacagcagtgggtgctatgtagaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaaccggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaagaaaggaaggaaagaagggagggaaacagggagaaagggaaaaagaagaaaaagagaaagatgaaaataggaacaaataaagacaaacaacattaagggccatattgtaagatttccatgttaatgatctaatataatcactcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattacaaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatgaaaattgcacgcatattagagttaaccatgtactattgatacagcaacgctacattgcaaataaaagtccgatcccaaaaggagaatgag

SEQ ID NO: 2497 - DNA, 2978 bp, Homo sapiens
aaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatacgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtctggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcgggagatagccctcctttgtccttctcccaaactaatgtgcagatgagcagcatggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgcccaggatatccaggaaaataactttgcagagagcttagtgatgacaaccactgtcagccacaatacaactatgccattcaggatttcaatgacttttaagaacaatagcccttcaggcggcgaaacgaagtgtgtcttctggaacttcaggcttgccaacaacacaggggggtgggacagcagtgggtgctatgtagaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaaccggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacagcagcccctaagatccccccaggccatgacggaaaccttgttagcggtggcagttcagcaatctgatggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaa

SEQ ID NO: 2498 - DNA, 1193 bp, Homo sapiens
tgaacccacagctcctctgcccctggcccatgagaatttcagctggagagatagcatgccctggtaagtgaagtcctgccacttcgagacatggaatcatctttctcatttggagtgatccttgctgtcctggcctccctcatcattgctactaacacactagtggctgtggctgtgctgctgttgatccacaagaatgatggtgtcagtctctgcttcaccttgaatctggctgtggctgacaccttgattggtgtggccatctctggcctactcacagaccagctctccagcccttctcggcccacacagaagaccctgtgcagcctgcggatggcatttgtcacttcctccgcagctgcctctgtcctcacggtcatgctgatcacctttgacaggtaccttgccatcaagcagcccttccgctacttgaagatcatgagtgggttcgtggccggggcctgcattgccgggctgtggttagtgtcttacctcattggcttcctcccactcggaatccccatgttccagcagactgcctacaaagggcagtgcagcttctttgctgtatttcaccctcacttcgtgctgaccctctcctgcgttggcttcttcccagccatgctcctctttgtcttcttctactgcgacatgctcaagattgcctccatgcacagccagcagattcgaaagatggaacatgcaggagccatggctggaggttatcgatccccacggactcccagcgacttcaaagctctccgtactgtgtctgttctcattgggagctttgctctatcctggacccccttccttatcactggcattgtgcaggtggcctgccaggagtgtcacctctacctagtgctggaacggtacctgtggctgctcggcgtgggcaactccctgctcaacccactcatctatgcctattggcagaaggaggtgcgactgcagctctaccacatggccctaggagtgaagaaggtgctcacctcattcctcctctttctctcggccaggaattgtggcccagagaggcccagggaaagttcctgtcacatcgtcactatctccagctcagagtttgatggctaagacggtaagggcagagaagtttcaaagtgcctttctcctccccactctggagccccaactagatcagcaggagctagggggatgagagcacttgc

SEQ ID NO: 2499 - DNA, 4578 bp, Homo sapiens
ggccgagcccagctccccgcggcggccgctagcccccggccccgagccaccactccgacctagcggccgccgcccccggtgcgggatgaggagatccgcggccgccactgggccccatggaggagccgcagccgccccgcccaccagcgagcatggccttactgggcagccagcactccggcgccccctccgcggccggcccacctggcgggacttcctccgcggccacggcggccgtgctctccttcagcaccgtggcgaccgcggcgctggggaacctgagcgacgcaagcggaggcggcacagctgccgctcccggtggcggcggccttggcgggtccggggcagcgcgggaggcgggggcggcggtgaggcggccgctaggcccggaggcggcgccgctgctgtcgcacggagctgcagtggcggcccaggcgctcgtcctcctgctcatcttcctgctgtctagccttggcaactgcgcggtgatgggggtgattgtgaagcaccggcagctccgcaccgtcaccaacgccttcatcctgtcgctgtccctatcggatctgctcacggcgctgctctgcctgcccgccgccttcctggacctcttcactccgcccgggggttcggcgcctgccgccgccgcggggccctggcgcggcttctgcgccgccagccgcttcttcagctcgtgcttcggcatcgtgtccacgctcagcgtggcgctcatctcgttggaccgttactgcgctatcgtgcggccgccgcgggagaagatcggccgccgccgcgcgctgcagctgctggcgggcgcctggctgacggccctgggcttctccttgccctgggagctgctcggggcgccccgggaactcgcggcggcgcagagcttccacggctgcctctaccggacctccccggaccccgcgcagctgggcgcggccttcagcgtggggctggtggtggcctgctacctgctgcccttcctgctcatgtgcttctgccactaccacatctgcaagacggtgcgcctgtcggacgtgcgcgtgcggccggtgaacacctacgcgcgcgtgctgcgcttcttcagcgaggtgcgcacggccaccaccgtcctcatcatgatcgtcttcgtcatctgctgctgggggccctactgcttcctggtgctgctggccgccgcccggcaggcccagaccatgcaggccccctcgctcctcagcgtggtggccgtctggctgacctgggccaatggggccatcaaccctgtcatctacgccatccgcaatcccaacatttcgatgctcctagggcgcaaccgcgaggagggctaccggactaggaatgtggacgctttcctgcccagccagggcccgggtctgcaagccagaagccgcagtcgccttcgaaaccgctatgccaaccggctgggggcctgcaacaggatgtcctcttccaacccggccagcggagtggcaggggacgtggccatgtgggcccgcaaaaatccagttgtacttttctgccgagagggaccaccagagccggtgacggcagtgaccaaacagcctaaatccgaagctggggataccagcctctaagacggttggaatggccagcttatgaaggcaaatttccactcgcattatttaatgatggaagattctgggggagagttgtggatttcataaagccaaacatttaaagctagagacgggggaggcttaccactttccccaaacaacataaaagacaatgtcccttcttcaaaagtgccaaaaggaatgtaaaatgcaaaaattaaaacaatcttaaaccacataaccaagcattgtgaactgtaagtgccaaaaatgacaaaaataacattcactataactgaaaagctcatattataggaccacactgtgaaacaaacaaaacattgaatgcaaccagtattgttcaactacacagaatttcaggaatgaatggagaccttcagagctgcttgaaagcccctctaaatcgctaccatccaacaaaactttagcttctagagcttgcacctctgacatgctttgggtgcttagattgcaagtggaaaagtcttatccttacacacattggtgcacctcctcaccccaccccctaataacctttgtggaaaatttttaattcataacccatttaaaatcattttaggattttgaaaagctggttattattagataaaattcaaccatctgaaggacaaatagaagtatgaacataaagaaatgtgtcttttaaatgttttccaagattatatgtaaaaattaacattccttccacccgcgtcatacctccaaaatgatcttccttggaaaactttgaagttttatccttactctaacctgttacttttatttctgataaattttggaatgctgctctcagaatgctttcacatttaaaaaaatattttcattgtagaaaatttttgtcttttgaggtaaatttgatttttggatatagccaaaaatgtaatttgaagtcaagttgattgaataaggtgagtgatgccactttatttaaatttttattattttttaaaatgagacctctataaaacaacaaggttgggtttcctacgtggcttttagctaactgaaaacgattccaaagagaaattctaaaactattttgagaagcagcctcttggaattagcgtagacttttccaaatagatcataccctcctacatttagaaatttggtatattttgtattttttaaaatagctgatggttgctttatagctatgacttgtcgaagataatgtatttattaaagggagaataggtgtgggactatatgtaacggtattaaaacacaggcataaagttggagaagaacttcaagcaaactgaaaatatctttagaaatatgcaaatcaaagatgctttttaaatttctatcttagcagaaaagatggttttacaataattcaaaagcgtatgtgaactttctaatgttaaatacgactatacacagaatcatttactcagaatttttttaaatattatttttccctttcttttcctccatcctgccccttttcttcagtatttcatagccttaattgaacaagttatttacagtagatatgaaaagacattagctgtcgtatgaagatttcaatgtgaaatagccagcattttcttcctgtaaagtatttaaatatgtttttaagtatttctttgtttgacaggtgggtacatgtcattattttgtaatcaaaggtggaaatatatgagtcatgtcagagctaaagatgttttaattttttctgcttctcagggtatcatcacaaatcagaagtttgtaaattgtatatattttgctacactcaatgtagtacaaagtagatgagataatccctcccctctagcccttattttataaagcatatacagacttcatgcagctggactaacaaaaacaggtgtctgcggtatttgcctgttaaaggcaaaaaattgtgtattttttggcaccgagtcacttttgggatttagagagaaatgataaagtcttcaattataaaagacatcatagaatagaagtacagttgtgaataaagggcagagggttagagatcttagagtaaggaggtgagcgtgttgcaaaatagtgtgttgcctgagaagaagaattgaaggaaggcattgaaaaataaatgtgatatagaataaacctacctggtgagtgaagggaaaatctgagagattggaagtgacaaggtgatggcatgaaggactttaaggaagaaaaggaattccagccctaccttttcggtggcaggaagttttaggaaaggcatggcttgtgaaagaggccattctgttagtggctccgagagtcatggtaggcaagaattggaggggaaaaagagaaaattgttcataaattactgaacaatttacaatgctctaaattgtttgtttttaatccaaggctatccaactatttagtggtagaactaggatttgaactgcagtctgtttggcctcagaactccatgtttgtttctctctatccccacagaagtctacaggtaaggaaatcaatcatgatcaattatggtactgtcatcattatcatcatcgtgatcatcatctaccatttttgtttcctactttatataagggcaacttcctgggagctaaggctactaaaaggtagaagccacagtactcatctgcagagggcttacagcctcagcaaggaccttgtggctttgtaacaacaatcagccataacaagtttacttgtggaaaagaaaaggtgtagcactttcagaagaggctatcaaagaaaagagatgaacttggaagcaagagatacgcaggtataagtcagccacccatttgacccagtgtaaatacttagacaatcaatacctcaaaaggtgaagaaagaatgattctcaaaataatctaagacttcgacctttcgttgtgcttactatgagtatgcaattatagtgacttcatgggaaaacgagaaagaaaagctatgaaatattggaatggattaaatattgagtactatgtaa

SEQ ID NO: 2500 - DNA, 2540 bp, Homo sapiens
gccgagcccagctccccgcggcggccgctagcccccggccccgagccaccactccgacctagcggccgccgcccccggtgcgggatgaggagatccgcggccgccactgggccccatggaggagccgcagccgccccgcccaccagcgagcatggccttactgggcagccagcactccggcgccccctccgcggccggcccacctggcgggacttcctccgcggccacggcggccgtgctctccttcagcaccgtggcgaccgcggcgctggggaacctgagcgacgcaagcggaggcggcacagctgccgctcccggtggcggcggccttggcgggtccggggcagcgcgggaggcgggggcggcggtgaggcggccgctaggcccggaggcggcgccgctgctgtcgcacggagctgcagtggcggcccaggcgctcgtcctcctgctcatcttcctgctgtctagccttggcaactgcgcggtgatgggggtgattgtgaagcaccggcagctccgcaccgtcaccaacgccttcatcctgtcgctgtccctatcggatctgctcacggcgctgctctgcctgcccgccgccttcctggacctcttcactccgcccgggggttcggcgcctgccgccgccgcggggccctggcgcggcttctgcgccgccagccgcttcttcagctcgtgcttcggcatcgtgtccacgctcagcgtggcgctcatctcgttggaccgttactgcgctatcgtgcggccgccgcgggagaagatcggccgccgccgcgcgctgcagctgctggcgggcgcctggctgacggccctgggcttctccttgccctgggagctgctcggggcgccccgggaactcgcggcggcgcagagcttccacggctgcctctaccggacctccccggaccccgcgcagctgggcgcggccttcagcgtggggctggtggtggcctgctacctgctgcccttcctgctcatgtgcttctgccactaccacatctgcaagacggtgcgcctgtcggacgtgcgcgtgcggccggtgaacacctacgcgcgcgtgctgcgcttcttcagcgaggtgcgcacggccaccaccgtcctcatcatgatcgtcttcgtcatctgctgctgggggccctactgcttcctggtgctgctggccgccgcccggcaggcccagaccatgcaggccccctcgctcctcagcgtggtggccgtctggctgacctgggccaatggggccatcaaccctgtcatctacgccatccgcaatcccaacatttcgatgctcctagggcgcaaccgcgaggagggctaccggactaggaatgtggacgctttcctgcccagccagggcccgggtctgcaagccagaagccgcagtcgccttcgaaaccgctatgccaaccggctgggggcctgcaacaggatgtcctcttccaacccggccagcggagtggcaggggacgtggccatgtgggcccgcaaaaatccagttgtacttttctgccgagagggaccaccagagccggtgacggcagtgaccaaacagcctaaatccgaagctggggataccagcctctaagacggttggaatggccagcttatgaaggcaaatttccactcgcattatttaatgatggaagattctgggggagagttgtggatttcataaagccaaacatttaaagctagagacgggggaggcttaccactttccccaaacaacataaaagacaatgtcccttcttcaaaagtgccaaaaggaatgtaaaatgcaaaaattaaaacaatcttaaaccacataaccaagcattgtgaactgctatccaactatttagtggtagaactaggatttgaactgcagtctgtttggcctcagaactccatgtttgtttctctctatccccacagaagtctacagggcaacttcctgggagctaaggctactaaaaggtagaagccacagtactcatctgcagagggcttacagcctcagcaaggaccttgtggctttgtaacaacaatcagccataacaagtttacttgtggaaaagaaaaggtgtagcactttcagaagaggctatcaaagaaaagagatgaacttggaagcaagagatacgcagctcagcatgacagagactccattccaggtggaaaaagcacatggctctttcttctccgagatcccaggactatcttattttcctcagaggggcaggttacaagaacttcacatctctcaggctacatgttgcaaaggttaaattccaggttgtacgatttttcacttccaccatcaagttatgagtgtgattgtttccctgcagttttgccaatagagtgattttagactatttacatcgtgggttacaaccaatgtcagttattctggggaaacccaactgccatgttgtgaggacactcaagcagccctatggaggagcccacatggtgagtgaataactacaagctgactctaattttaaaaaataaaaattttatctctcaccaattttaaaatg

SEQ ID NO: 2501 - DNA, 1483 bp, Homo sapiens
ggccgccgcccccggtgcgggatgaggagatccgcggccgccactgggccccatggaggagccgcagccgccccgcccaccagcgagcatggccttactgggcagccagcactccggcgccccctccgcggccggcccacctggcgggacttcctccgcggccacggcggccgtgctctccttcagcaccgtggcgaccgcggcgctggggaacctgagcgacgcaagcggaggcggcacagctgccgctcccggtggcggcggccttggcgggtccggggcagcgcgggaggcgggggcggcggtgaggcggccgctaggcccggaggcggcgccgctgctgtcgcacggagctgcagtggcggcccaggcgctcgtcctcctgctcatcttcctgctgtctagccttggcaactgcgcggtgatgggggtgattgtgaagcaccggcagctccgcaccgtcaccaacgccttcatcctgtcgctgtccctatcggatctgctcacggcgctgctctgcctgcccgccgccttcctggacctcttcactccgcccgggggttcggcgcctgccgccgccgcggggccctggcgcggcttctgcgccgccagccgcttcttcagctcgtgcttcggcatcgtgcacgctcagcgtggcgctcatctcgttggaccgttactgcgctatcgtcggccgccgcgggagaagatcggccgccgccgcgcgctgcagctgctggcgggcgcctggctgacggccctgggcttctccttgccctgggagctgctcggggcgccccgggaactcgcggcggcgcagagcttccacggctgcctctaccggacctccccggaccccgcgcagctgggcgcggccttcagcgtggggctggtggtggcctgctacctgctgcccttcctgctcatgtgcttctgccactaccacatctgcaagacggtgcgcctgtcggacgtgcgcgtgcggccggtgaacacctacgcgcgcgtgctgcgctcttcagcgaggtgcgcacggccaccaccgtcctcatcatgatcgtcttcgtcatctgctgctgggggccctactgcttcctggtgctgctggccgccgcccggcaggcccagaccatgcaggccccctcgctcctcagcgtggtggccgtctggctgacctgggccaatggggccatcaaccctgtcatctacgccatccgcaatcccaacatttcgatgctcctagggcgcaaccgcgaggagggctaccggactaggaatgtggacgctttcctgcccagccagggcccgggtctgcaagccagaagccgcagtcgccttcgaaaccgctatgccaaccggctgggggcctgcaacaggatgtcctcttccaacccggccagcggagtggcaggggacgtggccatgtgggcccgcaaaaatccagttgtacttttctgccgagagggaccaccagagccggtga

SEQ ID NO: 2502 - DNA, 1485 bp, Homo sapiens
ctccctctctgcaccctgcaattcccacccctccgtatttatttccctggtcccgccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgcccc

SEQ ID NO: 2503 - DNA, 1478 bp, Homo sapiens
gataaggaaaggaacctcctccctggctgggatggctgcccgggcgcgggaggagggccggggacccggtgagggaggaccgtagggcccgtgggggcttcacgcctggcaggcggccggccaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccaca

SEQ ID NO: 2504 - DNA, 1495 bp, Homo sapiens
actcggctcaaactctgggatctggaacatgctctgggctgtgaggacaagatgttacgtagtcaaggcacagctggggccaacggtggccctggaaggcagagcaccccgggctccgggccctagttgcttgggcaacgggaactgtcagcgacctggcccaatcacctctcggaacgtcactcgggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagca

SEQ ID NO: 2505 - DNA, 1596 bp, Homo sapiens
atctccctctctgcaccctgcaattcccacccctccgtatttatttccctggtcccgccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccaca

SEQ ID NO: 2506 - DNA, 542 bp, Homo sapiens
atcttggctatgggcggaagttttcttcagagaccgagggacgggaatccgttgccgcccccggccgggcggcacgaccccgatttgggtataggagagaggagcgtgggaactggcggacccccatacaagcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatg

SEQ ID NO: 2507 - DNA, 560 bp, Homo sapiens
gtaaccccgggcgcccgccagcggcgcagctcgcgccaattctcgcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacag

SEQ ID NO: 2508 - DNA, 350 bp, Homo sapiens
tctcctccactagctctgagtggggccacaggaccactacgcttgccggacacaaggccccacaggtggaagagggagtcttgctttgtcacccaggctggagtacagtgatgtgatcttggctcactgcaacctctgctcaccaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctg

SEQ ID NO: 2509 - DNA, 998 bp, Homo sapiens
gattactgcgggcgaaggcgcttggcacagccacaactgaagctcagccgtcggatgtgattattgttgctattgttaccgctccgcctggactgggtgcccggtcggaaagtcccgctccccgctcctcctcccaggcgcggaagcttcgcgccgcccgcctcgggggacacctcccgcgccatctcgggggcactggagataaggaaaggaacctcctccctggctgggatggctgcccgggcgcgggaggagggccggggacccggtgagggaggaccgtagggcccgtgggggcttcacgcctggcaggcggccggccaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgc

SEQ ID NO: 2510 - DNA, 1843 bp, Homo sapiens
ggatccaaggctcctcgtccgcatcctttttcctccctccttcggccccggggctcacatcctcgctgcctcacaccttgggcgtgtgtgggagcaggagagggattctctggggtccccatttggaacctggagacccacttctgccaacaagtccttcagcccctctgggccttagtttccccccagtgaagtggggatagtgacagctcccccgggagccagtgaaaactttgtgaagggagtgattactgcgggcgaaggcgcttggcacagccacaactgaagctcagccgtcggatgtgattattgttgctattgttaccgctccgcctggactgggtgcccggtcggaaagtcccgctccccgctcctcctcccaggcgcggaagcttcgcgccgcccgcctcgggggacacctcccgcgccatctcgggggcactggagataaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggcggacctggtgaatgacctggggaacaaaggctacctggtatttggcctcatcctcttcgtgtgggagctactgcccaccaccctgctggtgggcttcttccgggtgcaccggcccccacaggacctgtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacagttgtg

SEQ ID NO: 2511 - DNA, 527 bp, Homo sapiens
agccggggagccggagccccgggtccccacgacctgagccggctctcccatcagcggcctgaggacctggcgtccgcctcctccctccccttgaggctggagcgtggacgcggtgggggagggtggggcgggggcagctttcgagaattacgaggacaggaggcagaggccctccccatccgcattattggaggagagagagcctcccccagcttggggagggggagagcggggcattgggcgcccctcgcagcggccgctgccctgacccgacgggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctcctt

SEQ ID NO: 2512 - DNA, 1114 bp, Homo sapiens
agcggccgctgccctgacccgacgggtatcagccggctctccccctccacccaggacgacatgaacgaccgaggccagggagtcctctccttgggcctctgcatccccccatccttggctctggggtaggcccagggaggagacacccccaacccctatccggtctgtcctggagaaaagagactgcccttccatgcccctgagtgaggggcctggggcccaggctgcctgtgttccccaagggcaagggtctctctgttgaggaggaggggcctgtcagccacaacttctttcctcctgagcgccccatctccctctctgcaccctgcaattcccacccctccgtatttatttccctggtcccgccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccggcgggcgccctccactagcatctacctggaggccaaggtagggctgcagcactgatgcccaggtgtcttttgggtctctcggcagcggttctcagggtgtagag

SEQ ID NO: 2513 - DNA, 805 bp, Homo sapiens
agttttcttcagagaccgagggacgggaatccgttgccgcccccggccgggcggcacgaccccgatttgggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactg

SEQ ID NO: 2514 - DNA, 803 bp, Homo sapiens
ctttcctccagtctcggggctgcaggctgagcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggtcagtgggggcgctgaggaggtgtcacctgaccagggactcttggtatcctcgaggcattggttccaggaccccagaaaataccaaaatctggatgctcaagtccctgatataaaatggtgtagtatctgcatataacctacacgcatccttctgtata

SEQ ID NO: 2515 - DNA, 2039 bp, Homo sapiens
gcggcttgttttctttcctccagtctcggggctgcaggctgagcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcaggtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggttttgctccagattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgcaatcatgttgtagtttgcacagacttttatgcataattcactttaaaaatatagaatatatggtctaatagttttttaaagcttttggactaaagtattccacaaatcttacctctttaggtcactgatggtcactccgattctgagtgccacattggtagactcctaaaatacagttgacaacttagccaattgcaactccagtgttgataattaaaatgaaatggtaaagcagcagactgtaaggtctttagagattttttttttaaggttcaggccgtaggttcctcaaggaatctcttaagttttgcccaaagactggtacttcctttcagtagggcgctaatgtatacacattaatgataagttgataacattaaaaatgtagctgacttatcctattaaacctcctctgctatgttcac

SEQ ID NO: 2516 - DNA, 1698 bp, Homo sapiens
agtctcggggctgcaggctgagcgcgatgcgcggagacccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcaggtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggttttgctccagattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgcaatcatgttgtagtttgcacagacttttatgcataattcactttaaaaatatagaatatatggtctaatagttttttaaagcttttggactaaagtattccacaaatcttacctctttaggtcactgatggtcactccgattctgagtgcca

SEQ ID NO: 2517 - DNA, 844 bp, Homo sapiens
acaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcaggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatg

SEQ ID NO: 2518 - DNA, 1104 bp, Homo sapiens
tgcaggtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgca

SEQ ID NO: 2519 - DNA, 3888 bp, Homo sapiens
atgagggtgtccgtgccgggtccggcggccgctgccgcccccgcagccggccgcgagccctccacgcccggcgggggcagcggaggcggaggcgccgtcgctgcagcctcaggcgccgcggtgccgggctccgtgcagttggcgctgagcgtcctgcacgccctgctctacgccgcgctgttcgcctttgcctacctgcagctgtggcggctgctcctgtaccgcgagcggcggctgagttaccagagcctctgcctcttcctctgtctcctgtgggcagcgctcaggaccaccctcttctccgccgccttctcgctcagcggctccctgcccttgctccggccgcccgctcacctgcacttcttcccccactggctgctctactgcttcccctcctgtctccagttctccacgctctgtctcctcaacctctacctggcggaggttatatgtaaagtcagatgtgccactgaacttgacagacacaaaattctactgcatttgggctttataatggcaagcctgctctttttagtggtgaacttgacttgcgcaatgctagttcatggagatgtcccagaaaatcagttgaagtggactgtgtttgttcgagcattaattaatgatagcctgtttattctttgtgccatctctttagtgtgttacatatgcaaaattacaaaaatgtcatcagctaatgtctacctcgaatcaaagggtatgtctctgtgccagactgtcgtcgtgggctctgtagtcattcttctgtactcttccagagcttgttataatttggtggtggtcaccatatctcaggatacattagaaagtccatttaattatggctgggataatctttcagataaggctcatgtagaagacataagtggagaagagtatatagtatttggaatggtcctctttctgtgggaacatgtgccagcatggtcggtggtactgtttttccgggcacagagattaaaccagaatttggcacctgctggcatgataaatagtcacagttatagttccagagcttactttttcgacaatccaagacgatatgatagtgatgatgacctgccaagactgggaagttcaagagaaggaagtttaccaaattcgcaaagtttgggctggtatggcaccatgactgggtgtggcagcagcagttacacagtcactccccacctgaatggacctatgacagatactgctcctttgctctttacttgtagtaatttagatttgaacaatcatcatagcttatatgtgacaccacaaaactgacagcatcaccaagtcatgattcttgagttgtttttcataaatgtgtatattcaatgtgtttaaattccatctacataaacattccattatctgttgcaactgaaaacaaaatctggaagtgtggctgtgtttggtaaataacacagctattatttttgacctcttcatagtaaaatgaagtaaaatggaaagtttggagtaggagaaaagagagattagatcttaaggcacttgatggcctccaaaaatcctgactttggaacatcaaatgcatatgtgcacttttatctttgttctgagtcactgcagtccccaaagtcatatgccaatgttcacactgaaatactgtattgtacaccaaactggaaggcaattttcctatgaaaatcaaagccggtatattcattggtatgctctatacagatatcttaataaaaattttatagtgtgaacagtgcacagagttaaggcataaaaatgtatcattctttataaaaatctactgaaaatgtgtaatcattgaagacagttcttttaagcatgattttaaaatagcaactgaaattcaatcattttaaacaaatgatggtagtaatccattagttatggccagcagtgttctttggagagccacaataatttcaagaggaaaatataccagtgaaaattgtgtggctattttgagtagaattggtcagttgattattttgtgtaattgagatatatgtagtagtttaagcatgattcttgaagaaagcaatagtgacttttgcatagggagattttggtagaaacttcttgggactaaacaagtttagagatgcatttaagaattattcacaaaatgtgtaattctaaattaaaacataaatatattttcaaaagcatttgatttctctgaagcatgatatagctggtcttacctagtgaatcaggattgtcctcaggtaaatgaaatcatgatacattattgcagtgaactcaagtgcaatactttgtaagacatataattcctatgattttcacatttttatatcttatatatgggaaaagccaaattaaattgaattcagattaattccagcattagactaaatgagcaaacttaagtaaatgtacaaactaggtaagtataaaaccacaggttaacaatattggagtacttttagaattacattaaaactgtcttaaatgtcctatcccaaatctaaaaaaaaagaaaatggcaggctgagataatacagaattttaaaatgcactttgtaccagtgtctatatggaaagaagtagatgctgaatacctcaagatgccaagggaacaagcaacattgggaagttgtcacaacatgctcaaagacaaactacaattgtctgctagctatttcttcagaactggaactaatacgactatccttttctgttttatactttgattagaatgttatttcctcgcttacttaaaatgtacttcaactttttaacaactgatacaataacttcataaaagtataacactaggttgaaaccttaaggaaaaattgaaattgttaatgctttcgatcttttgggaggccagtacacagacaaataaatttcttctttttatgatacaaaatgactttgtattcaatcagaagcatatacttatgttattttgggtttgtttataattctctcattgtaaccaaattattttaaaatgtatagtataaaaagttacccgtggtattaagtgacaaaagcgtacttttattacaactccagttgttagattgcttctcagaatgctaactgtttattttgctaataatgttaggcatctaatcatctagagctgtccaaaaagatatgttgtctttgttaatccttggggttcaaggtgataaagtttttctagtaaggctcccctcgataatgttcctatttgaccaaactaacaaagattactttttaaaaatttttcagataaaataacttggttctttctgctgcattagttgattgttccaaatttgaggtttgtaagtttattcttatcactgactagggtacccaaattcttgcatttgtctccttatacacatctaacatatcaccaaagacaaataaagatacactctggcccaatctttgcttaaaaattccaaagcactaggagcactttaagtttggtctcgaaaggagttgtttataaaatcaaagggctaccgattccctgttcatcctgcactgaagcacatgatgacagtatcaaaccttcatttttgttcattaaaaagtgaatttcattacttaagtgtgtaattctatagtgattagcagtatttgttttcatcatttcacttgggtggccattaattttgaaacctttaccactcattgtagttggttgtagttttatggaaaatgtaatttatagctaaagtggcttttttatgcatagctgccttttttattgtttaacagtgtttctcagctatataatcagtttcaaactggttgtaaaagtatagctgtggccaatgaatgtatttatttgttgtttcactaaattgtaacaaaacactactattaaaaataaaagtgtttgtgctttta

SEQ ID NO: 2520 - DNA, 1281 bp, Homo sapiens
atcacggccaagggtaggagccagtcctgcggggagagaggcgctgctgctccagctgccgctgcctccgccgccgccaccaccgagccggcgaccagagtcgggctggcaggccgggcgcgaagcggcaaggggagcgaggggcgcgctcatggagcacacgcacgcccacctcgcagccaacagctcgctgtcttggtggtcccccggctcggcctgcggcttgggtttcgtgcccgtggtctactacagcctcttgctgtgcctcggtttaccagcaaatatcttgacagtgatcatcctctcccagctggtggcaagaagacagaagtcctcctacaactatctcttggcactcgctgctgccgacatcttggtcctctttttcatagtgtttgtggacttcctgttggaagatttcatcttgaacatgcagatgcctcaggtccccgacaagatcatagaagtgctggaattctcatccatccacacctccatatggattactgtaccgttaaccattgacaggtatatcgctgtctgccacccgctcaagtaccacacggtctcatacccagcccgcacccggaaagtcattgtaagtgtttacatcacctgcttcctgaccagcatcccctattactggtggcccaacatctggactgaagactacatcagcacctctgtgcatcacgtcctcatctggatccactgcttcaccgtctacctggtgccctgctccatcttcttcatcttgaactcaatcattgtgtacaagctcaggaggaagagcaattttcgtctccgtggctactccacggggaagaccaccgccatcttgttcaccattacctccatctttgccacactttgggccccccgcatcatcatgattctttaccacctctatggggcgcccatccagaaccgctggctggtacacatcatgtccgacattgccaacatgctagcccttctgaacacagccatcaacttcttcctctactgcttcatcagcaagcggttccgcaccatggcagccgccacgctcaaggctttcttcaagtgccagaagcaacctgtacagttctacaccaatcataacttttccataacaagtagcccctggatctcgccggcaaactcacactgcatcaagatgctggtgtaccagtatgacaaaaatggaaaacctataaaagtatccccgtgattccataggtgtggcaactactgcctctgtctaatccatttccagatgggaaggtgtcccatcctatg

SEQ ID NO: 2521 - DNA, 1613 bp, Homo sapiens
gtggagcgggtccgaggtgggaggcgcacagacgggctccgggagcccctcccgaggccccgcgcagcgcgccccgcaccctgcgccccgcgccctgcgggagggctgagccaagactccaggcgggcaggtgcggagcgagcagaggggatcacggccaagggtaggagccagtcctgcggggagagaggcgctgctgctccagctgccgctgcctccgccgccgccaccaccgagccggcgaccagagtcgggctggcaggccgggcgcgaagcggcaaggggagcgaggggcgcgctcatggagcacacgcacgcccacctcgcagccaacagctcgctgtcttggtggtcccccggctcggcctgcggcttgggtttcgtgcccgtggtctactacagcctcttgctgtgcctcggtttaccagcaaatatcttgacagtgatcatcctctcccagctggtggcaagaagacagaagtcctcctacaactatctcttggcactcgctgctgccgacatcttggtcctctttttcatagtgtttgtggacttcctgttggaagatttcatcttgaacatgcagatgcctcaggtccccgacaagatcatagaagtgctggaattctcatccatccacacctccatatggattactgtaccgttaaccattgacaggtatatcgctgtctgccacccgctcaagtaccacacggtctcatacccagcccgcacccggaaagtcattgtaagtgtttacatcacctgcttcctgaccagcatcccctattactggtggcccaacatctggactgaagactacatcagcacctctgtgcatcacgtcctcatctggatccactgcttcaccgtctacctggtgccctgctccatcttcttcatcttgaactcaatcattgtgtacaagctcaggaggaagagcaattttcgtctccgtggctactccacggggaagaccaccgccatcttgttcaccattacctccatctttgccacactttgggccccccgcatcatcatgattctttaccacctctatggggcgcccatccagaaccgctggctggtacacatcatgtccgacattgccaacatgctagcccttctgaacacagccatcaacttcttcctctactgcttcatcagcaagcggttccgcaccatggcagccgccacgctcaaggctttcttcaagtgccagaagcaacctgtacagttctacaccaatcataacttttccataacaagtagcccctggatctcgccggcaaactcacactgcatcaagatgctggtgtaccagtatgacaaaaatggaaaacctataaaagtatccccgtgattccataggtgtggcaactactgcctctgtctaatccatttccagatgggaaggtgtcccatcctatggctgagcagctctccttaagagtgctaatccgatttcctgtctcccgcagactgggcaattctcagactggtagatgagaagagatggaagagaagaaaggagagcatgaagcttgtttttacttatgcatttatttccacagagtcgtaatgacagcaaaagctcctaccagtttgaagat

SEQ ID NO: 2522 - DNA, 918 bp, Homo sapiens
atgcctggccacaatacctccaggaattcctcttgcgatcctatagtgacaccccacttaatcagcctctacttcatagtgcttattggcgggctggtgggtgtcatttccattcttttcctcctggtgaaaatgaacacccggtcagtgaccaccatggcggtcattaacttggtggtggtccacagcgtttttctgctgacagtgccatttcgcttgacctacctcatcaagaagacttggatgtttgggctgcccttctgcaaatttgtgagtgccatgctgcacatccacatgtacctcacgttcctattctatgtggtgatcctggtcaccagatacctcatcttcttcaagtgcaaagacaaagtggaattctacagaaaactgcatgctgtggctgccagtgctggcatgtggacgctggtgattgtcattgtggtacccctggttgtctcccggtatggaatccatgaggaatacaatgaggagcactgttttaaatttcacaaagagcttgcttacacatatgtgaaaatcatcaactatatgatagtcatttttgtcatagccgttgctgtgattctgttggtcttccaggtcttcatcattatgttgatggtgcagaagctacgccactctttactatcccaccaggagttctgggctcagctgaaaaacctattttttataggggtcatccttgtttgtttccttccctaccagttctttaggatctattacttgaatgttgtgacgcattccaatgcctgtaacagcaaggttgcattttataacgaaatcttcttgagtgtaacagcaattagctgctatgatttgcttctctttgtctttgggggaagccattggtttaagcaaaagataattggcttatggaattgtgttttgtgccgttag

SEQ ID NO: 2523 - DNA, 1270 bp, Homo sapiens
gtagccatcactgagaaatctggattttcaagcaatgattttcaacaattataaaatggaagttgtagactggataagagatgctcagctaagggagttcctggatggtctttagattgatacaccaatcctctgaaattgcatgcaaaaatgttttcctgggatcagctgcactccttagcaaaagtatattggagaatcaactgagaaagtaactgagacatttcaatcatttctaggtgtaaagaaagaccagatcccaggaaaatattacggtgacttcccaagtatgcctggccacaatacctccaggaattcctcttgcgatcctatagtgacaccccacttaatcagcctctacttcatagtgcttattggcgggctggtgggtgtcatttccattcttttcctcctggtgaaaatgaacacccggtcagtgaccaccatggcggtcattaacttggtggtggtccacagcgtttttctgctgacagtgccatttcgcttgacctacctcatcaagaagacttggatgtttgggctgcccttctgcaaatttgtgagtgccatgctgcacatccacatgtacctcacgttcctattctatgtggtgatcctggtcaccagatacctcatcttcttcaagtgcaaagacaaagtggaattctacagaaaactgcatgctgtggctgccagtgctggcatgtggacgctggtgattgtcattgtggtacccctggttgtctcccggtatggaatccatgaggaatacaatgaggagcactgttttaaatttcacaaagagcttgcttacacatatgtgaaaatcatcaactatatgatagtcatttttgtcatagccgttgctgtgattctgttggtcttccaggtcttcatcattatgttgatggtgcagaagctacgccactctttactatcccaccaggagttctgggctcagctgaaaaacctattttttataggggtcatccttgtttgtttccttccctaccagttctttaggatctattacttgaatgttgtgacgcattccaatgcctgtaacagcaaggttgcattttataacgaaatcttcttgagtgtaacagcaattagctgctatgatttgcttctctttgtctttgggggaagccattggtttaagcaaaagataattggcttatggaattgtgttttgtgccgttagccacaaactacagtattcatatttgcttcctttatattgggaataaaaatgggtataggggag

SEQ ID NO: 2524 - DNA, 677 bp, Homo sapiens
gagcatggaaatgacccagctgccctgctgttgaaacagaatcctatttggaaggcagacatgtggcccatctctgtagccatcactgagaaatctggattttcaagcaatgattttcaacaattataaaatggaagttgtagactggataagagatgctcagctaagggagttcctggatggtctttagattgatacaccaatcctctgaaattgcatgcaaaaatggcctttctctctgttgcccaggctggagtttagcgactcaatcatggctcactgactgcagcatcgacctccggggctcaagtgatcctttcatctcagcctcctcagtagctgagactacaggtgacttcccaagtatgcctggccacaatacctccaggaattcctcttgcgatcctatagtgacaccccacttaatcagcctctacttcatagtgcttattggcgggctggtgggtgtcatttccattcttttcctcctggtgaaaatgaacacccggtcagtgaccaccatggcggtcattaacttggtggtggtccacagcgtttttctgctgacagtgccatttcgcttgacctacctcatcaagaagacttggatgtttgggctgcccttctgcaaatttgtgagtgccatgctgcacatccacatgtacctcacgttccta

SEQ ID NO: 2525 - DNA, 1389 bp, Homo sapiens
atgagtattatgatgttgcccatggagcaaaagatccagtgggtccccacttccctgcaggacatcactgctgtcctgggtacagaagcatatactgaggaagacaaatcaatggtgtcccatgcacagaaaagccagcattcttgtctcagccattccaggtggctgaggtctccacaggtcacagggggaagctgggacctccgaataaggccatccaaggactccagcagtttccgccaggctcagtgtctgcgtaaggatcctggggcaaacaaccacttggagagccaaggggtgagaggtacagctggcgatgctgacagggagctgcggggaccctcagaaaaagccacagctggccagccacgagtgaccctgctgcccacgccccacgtcagcgggctgagccaggagtttgaaagccactggccagagatcgcagagaggtccccgtgtgtggctggcgtcatccctgtcatctactacagtgtcctgctgggcttggggctgcctgtcagcctcctgaccgcagtggccctggcgcgccttgccaccaggaccaggaggccctcctactactaccttctggcgctcacagcctcggatatcatcatccaggtggtcatcgtgttcgcgggcttcctcctgcagggagcagtgctggcccgccaggtgccccaggctgtggtgcgcacggccaacatcctggagtttgctgccaaccacgcctcagtctggatcgccatcctgctcacggttgaccgctacactgccctgtgccaccccctgcaccatcgggccgcctcgtccccaggccggacccgccgggccattgctgctgtcctgagtgctgccctgttgaccggcatccccttctactggtggctggacatgtggagagacaccgactcacccagaacactggacgaggtcctcaagtgggctcactgtctcactgtctatttcatcccttgtggcgtgttcctggtcaccaactcggccatcatccaccggctacggaggaggggccggagtgggctgcagccccgggtgggcaagagcacagccatcctcctgggcatcaccacactgttcaccctcctgtgggcgccccgggtcttcgtcatgctctaccacatgtacgtggcccctgtccaccgggactggagggtccacctggccttggatgtggccaatatggtggccatgctccacacggcagccaacttcggcctctactgctttgtcagcaagactttccgggccactgtccgacaggtcatccacgatgcctacctgccctgcactttggcatcacagccagagggcatggcggcgaagcctgtgatggagcctccgggactccccacaggggcagaagtgtag

SEQ ID NO: 2526 - DNA, 2892 bp, Homo sapiens
atggacgcaccttggggagcaggggaaaggtggctgcacggagcagcggtggacagatcaggagtctctctgggaccccctccaactccccaggtgaatcaaggaacccttgggccccaggttgcccccgtggccgccggcgaggtggtgaagactgcaggtggggtgtgcaagttctctggacagcgactgagctggtggcaggcccaagagtcctgcgagcagcagtttggccacttggcactgcagccccctgatggggttcttgcttcacggctgcgcgatccggtctgggtgggccaaagagaggcccctctgcggagacccccacagaggcgtgcgcgcaccaccgccgtgctggtgttcgacgagaggacggctgaccgggcggcgcggctgcggagccctctgcctgagctggcagcgctgaccgcgtgtactcacgtgcagtgggactgtgcctcgcccgaccccgcagcgctcttctccgttgccgcgcccgcgctgcccaacgcgctgcagctgcgcgccttcgccgagccggggggcgtcgtgcgcgctgcgctggtggtgcgtgggcagcacgcgcccttcctcgcagccttccgcgccgacggccgctggcaccatgtgtgcgccacgtgggagcagcggggcgggcgctgggcgctgttctccgatgggaggcggcgcgctggggcgcgggggctgggcgccggccacccggtgccgtccggcggcatcctggtgctgggccaggatcaggactctctgggcggtggcttctcggtgcgtcacgccctcagcggcaacctcaccgacttccacctgtgggcgcgggcgctgagccccgctcagctgcaccgggcacgggcctgcgcgccgccctcagagggcctgctcttccgctgggacccgggcgccctggacgtcacgccctcgctgctgcccactgtgtgggtgcgccttctctgtcccgtgccctccgaggagtgccctacgtggaacccgggacctcgcagtgagggctctgagctctgcctggagccgcagcccttcctctgctgctaccggacagagccctatcgtcggctgcaggatgcccagtcgtggcctggccaggatgttatcagccgagtcaatgccttggccaacgacattgtgctcctcccggaccccctctccgaagtccatggggccctgtccccagcggaggcctccagcttcctgggccttctggagcatgtcctggcgatggagatggctcccctggggccggccgcactgctggctgttgtccgcttcctgaagagggtggtggccctcggggctggggacccagagctgttgttgacaggcccctgggagcagctgagccaaggcgttgtatctgtggccagcctggtcctggaggagcaggtggctgacacatggctctccctccgtgaagtgattggtgggcctatggccctggtggcgagtgtgcagcgcctggcacccctgctgagcacctcaatgacctcagagcggccccgaatgcgcatccagcaccgccatgctggcctctctggagtcaccgtgatccacagctggttcacctccagagtcttccagcacaccctagagggaccggacctagagccccaggcccctgccagctcagaggaggcaaacagggtgcagaggttcctaagcacccaggtggggtcagccatcatctcctctgaagtgtgggacgtcactggagaggtcaacgtggccatgacctttcatctccagcaccgggcccagagccccctgttccctccccatcccccaagcccatatacagggggtgcctgggccaccacaggctgctccgtggctgccctgtacctggactccaccgcctgcttctgcaaccacagcaccagctttgccatcctgctgcaaatctatgaagtacagagaggccctgaggaggagtcgctgctgaggactctgtcatttgtgggctgtggcgtgtccttctgcgccctcaccaccaccttcttgctcttcctggtggccggggtccccaagtcagagcgaaccacagtccacaagaacctcaccttctccctggcctctgccgagggcttcctcatgaccagcgagtgggccaaggccaatgaggtggcatgtgtggctgtcacagtcgcaatgcacttcctctttctggtggcattctcctggatgctggtggaggggctgctgctgtggaggaaggtggtagctgtgagcatgcacccgggcccaggcatgcggctctaccacgccacaggctggggcgtgcctgtgggcatcgtggcggtcaccctggccatgctcccccatgactacgtggcccccggacattgctggctcaatgtgcacacaaatgccatctgggccttcgtggggcctgtgctcttcgtgctgactgccaacacctgcatcctggcccgtgtggtaatgatcaccgtgtccagtgcccgccgccgtgcccgcatgttgagcccacagccctgcctgcagcagcagatctggacccagatatgggccacggtgaagcccgtgctggtcctgctgcccgtcctaggcctgacctggctggcaggcatcctggtgcacctgagccccgcctgggcctacgctgccgtgggcctcaactccatccaggggctgtacatcttcctggtttatgctgcctgcaatgaggaggtgcggagcgccctgcagaggatggctgagaagaaggtggccgaggtgctcagggcactgggggtgtgggggggcgctgccaaggagcacagcctgcctttctctgtcctccccctctttctgccccctaagcccagcaccccccgtcaccctctgaaggccccggcctga

SEQ ID NO: 2527 - DNA, 1724 bp, Homo sapiens
gctggtggcaggcccaagagtcctgcgagcagcagtttggccacttggcactgcagccccctgatggggttcttgcttcacggctgcgcgatccggtctgggtgggccaaagagaggcccctctgcggagacccccacagaggcgtgcgcgcaccaccgccgtgctggtgttcgacgagaggacggctgaccgggcggcgcggctgcggagccctctgcctgagctggcagcgctgaccgcgtgtactcacgtgcagtgggactgtgcctcgcccgaccccgcagcgctcttctccgttgccgcgcccgcgctgcccaacgcgctgcagctgcgcgccttcgccgagccggggggcgtcgtgcgcgctgcgctggtggtgcgtgggcagcacgcgcccttcctcgcagccttccgcgccgacggccgctggcaccatgtgtgcgccacgtgggagcagcggggcgggcgctgggcgctgttctccgatgggaggcggcgcgctggggcgcgggggctgggcgccggccacccggtgccgtccggcggcatcctggtgctgggccaggatcaggactctctgggcggtggcttctcggtgcgtcacgccctcagcggcaacctcaccgacttccacctgtgggcgcgggcgctgagccccgctcagctgcaccgggcacgggcctgcgcgccgccctcagagggcctgctcttccgctgggacccgggcgccctggacgtcacgccctcgctgctgcccactgtgtgggtgcgccttctctgtcccgagccctatcgtcggctgcaggatgcccagtcgtggcctggccaggatgttatcagccgagtcaatgccttggccaacgacattgtgctcctcccggaccccctctccgaagtccatggggccctgtccccagcggaggcctccagcttcctgggccttctggagcatgtcctggcgatggagatggctcccctggggccggccgcactgctggctgttgtccgcttcctgaagagggtggtggccctcggggctggggacccagagctgttgttgacaggcccctgggagcagctgagccaaggcgttgtatctgtggccagcctggtcctggaggagcaggtgattggtgggcctatggccctggtggcgagtgtgcagcgcctggcacccctgctgagcacctcaatgacctcagagcggccccgaatgcgcatccagcaccgccatgctggcctggaggtgcggagcttacgcttgagggaggccagcacgaggggctgcttattcacaatgcctggtgggcgtccagaggggcccggccatatccacattcctgcgagtgaagtgaggcgactcctcaggaaaggcctctctggagtcaccgtgatccacagctggttcacctccagagtcttccagcacaccctagagggaccggacctagagccccaggcccctgccagctcagaggaggcaaacagggtgcagaggttcctaagcacccaggtggggtcagccatcatctcctctgaagtgtgggacgtcactggagaggtcaacgtggccatgacctttcatctccagcaccgggcccagcccatatacagggggtgcctgggccaccacaggctgctccgtggctgccctgtacctggactccaccgcctgcttctgcaaccacagcaccagctttgccatcctgctgcaaatctatga

SEQ ID NO: 2528 - DNA, 722 bp, Homo sapiens
tttctggtggcattctcctggatgctggtggaggggctgctgctgtggaggaaggtggtagctgtgagcatgcacccgggcccaggcatgcggctctaccacgccacaggctgggggccacggtgaagcccgtgctggtcctgctgcccgtcctaggcctgacctggctggcaggcatcctggtgcacctgagccccgcctgggcctacgctgccgtgggcctcaactccatccaggggctgtacatcttcctggtttatgctgcctgcaatgaggaggtgcggagcgccctgcagaggatggctgagaagaaggtggccgagggacctatggccctagaactccctcagcattctcctccattgcaaacccggagagacaggctgtggaactgacagcgttcaaagcttcaggtttctagagagtggctgggaaactcgtcgccaaaccctgcccagctcagctctgctgggaccccagaccccagaacggcgcagcgggagtccctgagccccaacagcggccccagctcccgtggcctcagcctctggctttccctaaaggactgtgggcctcagccccctgttcccctagcccaccaggtccccaggctctttcccccagtctttgcctatctgtgatctgctccttcccccatgctccgaagttccaacgggctctgccgtgtctggtaataaataggactgttgggctctcctgtc

SEQ ID NO: 2529 - DNA, 461 bp, Homo sapiens
ttttcctcagtccaagttggcctgcctgtgacccctgctgtctgtcacctgctccgttggatccaggatggcaccgtggtgctactgtttcctctgcctcctgatcaggagtctctctgggaccccctccaactccccaggtgaatcaaggaacccttgggccccaggccctgcgaggaacgcttcactggtttccgtctcattcctgccattgcgcagatgacgaaaagagctctgcaagaggacaggactcagcaggccatagacatgggcgggttcagccccatccagcccgaatgactccaagcccagtgtccttggctccgcccagccctggaagagtcagatgcccacaaaatgcaccccccaccgtctctcttatcgtttttagcccccgtggccgccggcgaggtggtgaagactgcaggtggggtgtgcaagttctctggacagcgactgag

SEQ ID NO: 2530 - DNA, 1757 bp, Homo sapiens
cgccggccgccatgtggagctgcagctggttcaacggcacagggctggtggaggagctgcctgcctgccaggacctgcagctggggctgtcactgttgtcgctgctgggcctggtggtgggcgtgccagtgggcctgtgctacaacgccctgctggtgctggccaacctacacagcaaggccagcatgaccatgccggacgtgtactttgtcaacatggcagtggcaggcctggtgctcagcgccctggcccctgtgcacctgctcggccccccgagctcccggtgggcgctgtggagtgtgggcggcgaagtccacgtggcactgcagatccccttcaatgtgtcctcactggtggccatgtactccaccgccctgctgagcctcgaccactacatcgagcgtgcactgccgcggacctacatggccagcgtgtacaacacgcggcacgtgtgcggcttcgtgtggggtggcgcgctgctgaccagcttctcctcgctgctcttctacatctgcagccatgtgtccacccgcgcgctagagtgcgccaagatgcagaacgcagaagctgccgacgccacgctggtgttcatcggctacgtggtgccagcactggccaccctctacgcgctggtgctactctcccgcgtccgcagggaggacacgcccctggaccgggacacgggccggctggagccctcggcacacaggctgctggtggccaccgtgtgcacgcagtttgggctctggacgccacactatctgatcctgctggggcacacggtcatcatctcgcgagggaagcccgtggacgcacactacctggggctactgcactttgtgaaggatttctccaaactcctggccttctccagcagctttgtgacaccacttctctaccgctacatgaaccagagcttccccagcaagctccaacggctgatgaaaaagctgccctgcggggaccggcactgctccccggaccacatgggggtgcagcaggtgctggcgtaggcggcccagccctcctggggagacgtgactctggtggacgcagagcacttagttaccctggacgctccccacatccttccagaaggagacgagctgctggaagagaagcaggaggggtgtttttcttgaagtttcctttttcccacaaatgccactcttgggccaaggctgtggtccccgtggctggcatctggcttgagtctccccgaggcctgtgcgtctcccaaacacgcagctcaaggtccacatccgcaaaagcctcctcgccttcagcctcctcagcattcagtttgtcaatgaagtgatgaaagcttagagccagtatttatactttgtggttaaaatacttgattcccccttgtttgttttacaaaaacagatgtttcctagaaaaatgacaaatagtaaaatgaacaaaaccctacgaaagaatggcaacagccagggtggccgggccctgccagtgggcggcgtgtgctagcaaggcctgccgggtgtgccgcagtcaccacagggttctgagaacatttcacagaagtgcctgagacgcggagacatggctggtgttaaatggagctattcaatagcagtgacgcgctctcctcagccaccaaatgtccctgacaccctccccagcccccacagataacatcagctgaggtttttttcagtatgaacctgtcctaaatcaattcctcaaagtgtgcacaaaactaaagaatataaataaacaaaagaaaggtg

SEQ ID NO: 2531 - DNA, 1966 bp, Homo sapiens
aagtgcttgcatcctggggccctcacacgcacgcgcaggcggccaggcgcgctgctgataagagcctgcgggtttgcagagaagcgcagcagcgcgcaggtcctcaccagagctctggtggccacctctgtcccgccatgctgctcaccgacagtggccagggcccacagcaccaagaggcttgggccacaaagtaaagggtcgcggagcctcgccggccgccatgtggagctgcagctggttcaacggcacagggctggtggaggagctgcctgcctgccaggacctgcagctggggctgtcactgttgtcgctgctgggcctggtggtgggcgtgccagtgggcctgtgctacaacgccctgctggtgctggccaacctacacagcaaggccagcatgaccatgccggacgtgtactttgtcaacatggcagtggcaggcctggtgctcagcgccctggcccctgtgcacctgctcggccccccgagctcccggtgggcgctgtggagtgtgggcggcgaagtccacgtggcactgcagatccccttcaatgtgtcctcactggtggccatgtactccaccgccctgctgagcctcgaccactacatcgagcgtgcactgccgcggacctacatggccagcgtgtacaacacgcggcacgtgtgcggcttcgtgtggggtggcgcgctgctgaccagcttctcctcgctgctcttctacatctgcagccatgtgtccacccgcgcgctagagtgcgccaagatgcagaacgcagaagctgccgacgccacgctggtgttcatcggctacgtggtgccagcactggccaccctctacgcgctggtgctactctcccgcgtccgcagggaggacacgcccctggaccgggacacgggccggctggagccctcggcacacaggctgctggtggccaccgtgtgcacgcagtttgggctctggacgccacactatctgatcctgctggggcacacggtcatcatctcgcgagggaagcccgtggacgcacactacctggggctactgcactttgtgaaggatttctccaaactcctggccttctccagcagctttgtgacaccacttctctaccgctacatgaaccagagcttccccagcaagctccaacggctgatgaaaaagctgccctgcggggaccggcactgctccccggaccacatgggggtgcagcaggtgctggcgtaggcggcccagccctcctggggagacgtgactctggtggacgcagagcacttagttaccctggacgctccccacatccttccagaaggagacgagctgctggaagagaagcaggaggggtgtttttcttgaagtttcctttttcccacaaatgccactcttgggccaaggctgtggtccccgtggctggcatctggcttgagtctccccgaggcctgtgcgtctcccaaacacgcagctcaaggtccacatccgcaaaagcctcctcgccttcagcctcctcagcattcagtttgtcaatgaagtgatgaaagcttagagccagtatttatactttgtggttaaaatacttgattcccccttgtttgttttacaaaaacagatgtttcctagaaaaatgacaaatagtaaaatgaacaaaaccctacgaaagaatggcaacagccagggtggccgggccctgccagtgggcggcgtgtgctagcaaggcctgccgggtgtgccgcagtcaccacagggttctgagaacatttcacagaagtgcctgagacgcggagacatggctggtgttaaatggagctattcaatagcagtgacgcgctctcctcagccaccaaatgtccctgacaccctccccagcccccacagataacatcagctgaggtttttttcagtatgaacctgtcctaaatcaattcctcaaagtgtgcacaaaactaaagaatataaataaacaaaagaaag

SEQ ID NO: 2532 - DNA, 1053 bp, Homo sapiens
gtgcgcgccgtgagccccgccgcctccgccagcccgagctgcccgcccggcggcgactgcgccggccgccgcccagcaagccgggtcgcggagcctcgccggccgccatgtggagctgcagctggttcaacggcacagggctggtggaggagctgcctgcctgccaggacctgcagctggggctgtcactgttgtcgctgctgggcctggtggtgggcgtgccagtgggcctgtgctacaacgccctgctggtgctggccaacctacacagcaaggccagcatgaccatgccggacgtgtactttgtcaacatggcagtggcaggcctggtgctcagcgccctggcccctgtgcacctgctcggccccccgagctcccggtgggcgctgtggagtgtgggcggcgaagtccacgtggcactgcagatccccttcaatgtgtcctcactggtggccatgtactccaccgccctgctgagcctcgaccactacatcgagcgtgcactgccgcggacctacatggccagcgtgtacaacacgcggcacgtgtgcggcttcgtgtggggtggcgcgctgctgaccagcttctcctcgctgctcttctacatctgcagccatgtgtccacccgcgcgctagagtgcgccaagatgcagaacgcagaagctgccgacgccacgctggtgttcatcggctacgtggtgccagcactggccaccctctacgcgctggtgctactctcccgcgtccgcagggaggacacgcccctggaccgggacacgggccggctggagccctcggcacacaggctgctggtggccaccgtgtgcacgcagtttgggctctggacgccacactatctgatcctgctggggcacacggtcatcatctcgcgagggaagcccgtggacgcacactacctggggctactgcactttgtgaaggatttctccaaactcctggccttctccagcagctttgtgacaccacttctctaccgctacatgaaccagagcttccccagcaagctccaacggctgatgaaaaagctgccct

SEQ ID NO: 2533 - DNA, 1562 bp, Homo sapiens
gcagagaagcgcagcagcgcgcaggtcctcaccagagctctggtggccacctctgtcccgccatgctgctcggccccccgagctcccggtgggcgctgtggagtgtgggcggcgaagtccacgtggcactgcagatccccttcaatgtgtcctcactggtggccatgtactccaccgccctgctgagcctcgaccactacatcgagcgtgcactgccgcggacctacatggccagcgtgtacaacacgcggcacgtgtgcggcttcgtgtggggtggcgcgctgctgaccagcttctcctcgctgctcttctacatctgcagccatgtgtccacccgcgcgctagagtgcgccaagatgcagaacgcagaagctgccgacgccacgctggtgttcatcggctacgtggtgccagcactggccaccctctacgcgctggtgctactctcccgcgtccgcagggaggacacgcccctggaccgggacacgggccggctggagccctcggcacacaggctgctggtggccaccgtgtgcacgcagtttgggctctggacgccacactatctgatcctgctggggcacacggtcatcatctcgcgagggaagcccgtggacgcacactacctggggctactgcactttgtgaaggatttctccaaactcctggccttctccagcagctttgtgacaccacttctctaccgctacatgaaccagagcttccccagcaagctccaacggctgatgaaaaagctgccctgcggggaccggcactgctccccggaccacatgggggtgcagcaggtgctggcgtaggcggcccagccctcctggggagacgtgactctggtggacgcagagcacttagttaccctggacgctccccacatccttccagaaggagacgagctgctggaagagaagcaggaggggtgtttttcttgaagtttcctttttcccacaaatgccactcttgggccaaggctgtggtccccgtggctggcatctggcttgagtctccccgaggcctgtgcgtctcccaaacacgcagctcaaggtccacatccgcaaaagcctcctcgccttcagcctcctcagcattcagtttgtcaatgaagtgatgaaagcttagagccagtatttatactttgtggttaaaatacttgattcccccttgtttgttttacaaaaacagatgtttcctagaaaaatgacaaatagtaaaatgaacaaaaccctacgaaagaatggcaacagccagggtggccgggccctgccagtgggcggcgtgtgctagcaaggcctgccgggtgtgccgcagtcaccacagggttctgagaacatttcacagaagtgcctgagacgcggagacatggctggtgttaaatggagctattcaatagcagtgacgcgctctcctcagccaccaaatgtccctgacaccctccccagcccccacagataacatcagctgaggtttttttcagtatgaacctgtcctaaatcaattcctcaaagtgtgcacaaaactaaagaatataaataaacaaaagaaaggtg

SEQ ID NO: 2534 - DNA, 1267 bp, Homo sapiens
gacccctgtggggcagatcaacactcaaggcaggtgcagaatcaacaacctgtgacaaagccagccatccctgccaggaagcatgggggatgagctggcaccttgccctgtgggcactacagcttggccggccctgatccagctcatcagcaagacaccctgcatgccccaagcagccagcaacacttccttgggcctgggggacctcagggtgcccagctccatgctgtactggcttttccttccctcaagcctgctggctgcagccacactggctgtcagccccctgctgctggtgaccatcctgcggaaccaacggctgcgacaggagccccactacctgctcccggctaacatcctgctctcagacctggcctacattctcctccacatgctcatctcctccagcagcctgggtggctgggagctgggccgcatggcctgtggcattctcactgatgctgtcttcgccgcctgcaccagcaccatcctgtccttcaccgccattgtgctgcacacctacctggcagtcatccatccactgcgctacctctccttcatgtcccatggggctgcctggaaggcagtggccctcatctggctggtggcctgctgcttccccacattccttatttggctcagcaagtggcaggatgcccagctggaggagcaaggagcttcatacatcctaccaccaagcatgggcacccagccgggatgtggcctcctggtcattgttacctacacctccattctgtgcgttctgttcctctgcacagctctcattgccaactgtttctggaggatctatgcagaggccaagacttcaggcatctgggggcagggctattcccgggccaggggcaccctgctgatccactcagtgctgatcacattgtacgtgagcacaggggtggtgttctccctggacatggtgctgaccaggtaccaccacattgactctgggactcacacatggctcctggcagctaacagtgaggtactcatgatgcttccccgtgccatgctcacatacctgtacctgctccgctaccggcagctgttgggcatggtccggggccacctcccatccaggaggcaccaggccatctttaccatttcctagagttcttgagtccacagtctggcaagctgaggttaaaaatcatatgttgaatgcagcagtgtccacttatgactaacttcttagaacagcacaatataatagtggaattgggcctttcagaagacctcaactgatgatttt

SEQ ID NO: 2535 - DNA, 2323 bp, Homo sapiens
cttggtaggaggaatgaaatctgatttgcagcagccggtctttcttttgagaaaattatcagactcattgataagggaaattaaatattgaccaaggacaatgtctttatttctcagtaacttatcaacaaatgactctagcctgtggaaagagaatcataattctacggaccttttaaatccgccaggaaccctgaatatctatcttttttgcttgacatgtctcatgacttttgcagccttggtgggcagcatttattcactaatttccctgctgaaaatgcagaacagaactgttgtgtccatgcttgtggcttcctggtctgtggatgatctcatgagcgtcctgtcggtgaccatcttcatgtttttgcagtggccaaacgaggtccccggttacttccaatttctgtgcaccacctctgccttaatgtatttatgccagggcctctctagcaacttgaaggcgactctcctagtctcttacaacttttatacgatgcacagaggtgtggggagccagacagcctccagaagatcgggccaggtgctcggcgtggtgctgaccgtgtgggcagccagtctgctgctctcggcgctcccgctgtgcggctggggcgccttcgtgcgcacgccctggggctgcctggtggactgctccagctcctacgtactattcctctctatcgtgtacgctttggccttcggactcctcgtgggcctctcagtcccactcactcaccgattgctgtgttcggaggagccgccgagactccactccaactaccaggaaatttcccgtggagcttcaattcctgggacccctcctactgcggggagagtggtttccctgtccccagaggatgctccaggcccgagtctgcggcgctctgggggatgctctccgagctccgacaccgtgttcggaccgggtgcgcccgctgccgctggggctgaagcctgcaggcgtgagaaccgggggactctctatggcaccaggagcttcaccgtgagcgtagcgcagaagcgcttcgctttgatcctagcgcttacaaaagtcgtcctttggctgcccatgatgatgcacatggtggtccagaacgtcgtggggtttcagagccttcccttggagacattcagctttctacttaccctgctggccaccactgtaaccccagtgtttgtcttgtccaaacgctggacccacttgccctgtggctgcatcatcaactgcaggcagaacgcatatgcagtggcgtccgatgggaaaaaaatcaagagaaaaggctttgaattcaatctatcattccaaaaaagttatgggatttataaaatagcacatgaagattactatgatgatgatgaaaattccatattctatcacaacctgatgaactctgagtgtgaaactacaaaagaccctcagagagacaaccgtaacatcttcaatgctataaaagtagaaatcagcaccacgccctctctggacagctccacacaaagaggcatcaacaaatgcacaaatactgatattacagaagctaaacaggattccaacaacaaaaaggatgcgttttctgacaaaacaggaggtgatattaactatgaagaaactaccttttctgaagggccagaaagaagactgtctcatgaagagagtcagaaaccagatctttcagactgggagtggtgtaggagtaaatcagaaagaacccctcgtcagcgttccggttatgcccttgccattcccttgtgtgcattccaggggactgtgtctctccatgcacctacagggaaaaccctatctctttctacctatgaggtaagcgcagaagggcaaaaaataactccagcctctaagaaaatagaagtctatcgatccaaaagtgttggccatgaaccaaactcagaagattcttcatccacgtttgtggacaccagtgtgaaaatacacttggaggttcttgaaatttgtgataatgaagaggccttggacactgtgtcaatcattagtaacatcagtcagtcctccacacaagtcagatctccatccctacgttactccaggaaagaaaacagatttgtttcatgtgacctaggggaaacagcctcatactccctctttttgcccaccagtaatcctgatggtgatattaatatctccattccagacacagtagaagcacacaggcagaacagtaaaaggcagcatcaagagagggatggctaccaggaggaaatccagttgttaaataaagcttacagaaaaagagaggaagaaagcaagggtagttagtgggtatttggtctaacaggagcaaga

SEQ ID NO: 2536 - DNA, 2065 bp, Homo sapiens
caaatcacgaggacaatcgacaaaaacaactaagcgcaaagccgcccgaatccatctccctctctgtgcgtgtgccttttcaactaactttgggaactcgtatagacccagcgtcgctccccgcgccgcctcgcctccactttggtttcccgcgtcctgcccgccctcttcggtgcctcctcttcctccgggacaaggatggaggatctctttagcccctcaattctgccgccggcgcccaacatttccgtgcccatcttgctgggctggggtctcaacctgaccttggggcaaggagcccctgcctctgggccgcccagccgccgcgtccgcctggtgttcctgggggtcatcctggtggtggcggtggcaggcaacaccacagtgctgtgccgcctgtgcggcggcggcgggccctgggcgggccccaagcgtcgcaagatggacttcctgctggtgcagctggccctggcggacctgtacgcgtgcgggggcacggcgctgtcacagctggcctgggaactgctgggcgagccccgcgcggccacgggggacctggcgtgccgcttcctgcagctgctgcaggcatccgggcggggcgcctcggcccacctcgtggtgctcatcgccctcgagcgccggcgcgcggtgcgtcttccgcacggccggccgctgcccgcgcgtgccctcgccgccctgggctggctgctggcactgctgctggcgctgcccccggccttcgtggtgcgcggggactccccctcgccgctgccgccgccgccgccgccaacgtccctgcagccaggcgcgcccccggccgcccgcgcctggccgggggagcgtcgctgccacgggatcttcgcgcccctgccgcgctggcacctgcaggtctacgcgttctacgaggccgtcgcgggcttcgtcgcgcctgttacggtcctgggcgtcgcttgcggccacctactctccgtctggtggcggcaccggccgcaggcccccgcggctgcagcgccctggtcggcgagcccaggtcgagcccctgcgcccagcgcgctgccccgcgccaaggtgcagagcctgaagatgagcctgctgctggcgctgctgttcgtgggctgcgagctgccctactttgccgcccggctggcggccgcgtggtcgtccgggcccgcgggagactgggagggagagggcctgtcggcggcgctgcgcgtggtggcgatggccaacagcgctctcaatcccttcgtctacctcttcttccaggcgggcgactgccggctccggcgacagctgcggaagcggctgggctctctgtgctgcgcgccgcagggaggcgcggaggacgaggaggggccccggggccaccaggcgctctaccgccaacgctggccccaccctcattatcaccatgctcggcgggaaccgctggacgagggcggcttgcgcccaccccctccgcgccccagacccctgccttgctcctgcgaaagtgccttctaggtgcttggtggtcagagacgggtcatctgtcgctaaggcgcaacctccagggaactcgaggcctgccagggtctgtccagatcacaaggggcaggagagtctgtgagagagtgacactgaagttgtccccttcctccactctcctattcccttctcatgtttacatttccctatgctcttccagtttctcttcttccctacagttcctctcatatctccccatttggagacagtgagccactggaaagttgtaaaaacaaaaacagttatttttgcagttttctttcacgcatttatagtgctctggataatgccatttatttttgctgattacccaactttcagtatttgctgtgttatcatctgtatttacttattttgaatcgtgcttaaatcaaatgtaccttcagcacctgcaagtttgccttttctttccaggaggaaaatccccacgttgctctccctggggagtctgagaattataccagtgctgtcagaaatgtaatcatgctgtcatttcagagccacagagtatttataaaataaaaacctttcccacgga

SEQ ID NO: 2537 - DNA, 3088 bp, Homo sapiens
tttcctatgcaaaagagcccaggcagaaagacaaacctaaataagaatctaacttctgtaagaagctgtgaagagtgatgctggcagctgcctttgcagactctaactccagcagcatgaatgtgtcctttgctcacctccactttgccggagggtacctgccctctgattcccaggactggagaaccatcatcccggctctcttggtggctgtctgcctggtgggcttcgtgggaaacctgtgtgtgattggcatcctccttcacaatgcttggaaaggaaagccatccatgatccactccctgattctgaatctcagcctggctgatctctccctcctgctgttttctgcacctatccgagctacggcgtactccaaaagtgtttgggatctaggctggtttgtctgcaagtcctctgactggtttatccacacatgcatggcagccaagagcctgacaatcgttgtggtggccaaagtatgcttcatgtatgcaagtgacccagccaagcaagtgagtatccacaactacaccatctggtcagtgctggtggccatctggactgtggctagcctgttacccctgccggaatggttctttagcaccatcaggcatcatgaaggtgtggaaatgtgcctcgtggatgtaccagctgtggctgaagagtttatgtcgatgtttggtaagctctacccactcctggcatttggccttccattattttttgccagcttttatttctggagagcttatgaccaatgtaaaaaacgaggaactaagactcaaaatcttagaaaccagatacgctcaaagcaagtcacagtgatgctgctgagcattgccatcatctctgctctcttgtggctccccgaatgggtagcttggctgtgggtatggcatctgaaggctgcaggcccggccccaccacaaggtttcatagccctgtctcaagtcttgatgttttccatctcttcagcaaatcctctcatttttcttgtgatgtcggaagagttcagggaaggcttgaaaggtgtatggaaatggatgataaccaaaaaacctccaactgtctcagagtctcaggaaacaccagctggcaactcagagggtcttcctgacaaggttccatctccagaatccccagcatccataccagaaaaagagaaacccagctctccctcctctggcaaagggaaaactgagaaggcagagattcccatccttcctgacgtagagcagttttggcatgagagggacacagtcccttctgtacaggacaatgaccctatcccctgggaacatgaagatcaagagacaggggaaggtgttaaatagatttaagtttcaaagcaaaacaaactgtgattattgtatttacttgtactgctgcttatcaatattgctgactttacaaactgatataattattaccattaggaattataaaaatatttcacaatctacactttccaaatgtgcaatgtggtaagtagagaaccatgttagaagtaataattgtttcagaattagaacttggcttcccaaacaatttaagtgttgtgtaaagatgttgctgtcaaagtgattagacagcctggctattctgtcatttgttcacagtggttttactgggtaccccctaggaccagccctgtagtggaccggctggagcctgcagtagaggttctgtcaaagctgagcccctttaccttcagtttcacccaggacctgctagtcctaattttacctactaaattgtatttcacataaccaaagctcaaaatctactttcacttgagatttttaacacattaatgataaattttaatgcgttcttcatttacttaataagtgttaatttacttgatgaaaagtccgtatcataatgttcatgactgaaggtcaaagaaaaagaaacagcaccttattccaattctggactcatttcaagccatggctggttctggccaagtttaaataaattcaaacttaaactaaagcctgcttcagtgaactttttaaagctacctgaatgagtcttcagtttctaagtctaagaattgtagcagctttccaatgacattcagtagtctgatatgggggaaaaaatacttaaaaaaatgtcctctcttcacttccaaaatgtgggaaagttatttttctataagcagaaatgtgttcctcctaatatctcctttctcccaagataaaccatggttaatgatataggtatagattactcctcaaatacaaatagaagatggagatggtgatctttcttgttaatggtactaaacttacccttactcagaacattgaacttgaaccctactcaacttttaaaatactataggctaagttataaaaataatctagcaacctgagaaagagattaatatcaaaaagagaaaattcaacaaaccaagacagaatttggttaagaatacaaaataaaaagcataagggcaatgcagaaagcagtaaaactgtgtacccagacatacggtaaaatctgagtaacaggcaataaccattcattttatagcaaggtaaaacatacccaataaaacatgattatgatatatttctgccccttttaagtataatgacattcacccatgattcttgattactttgttatggaactcgggtattttcactgaaagtttccctcagaatagaaatgcctttagggcaaaccaagccatggagaatctgaaatataaaggatatgttatggaaaaaaaaagattttgctttttgtctatgggtttccggattctttgctttttcataagtggtcatagtttgctttttaacacaggaggtagggctgtattctttttacatccttcattacaaattttatttgaagctcatgtattcaaataaagtaaaatttaacccaagaatccaaaatattgtcttgtgatatggtagttataaaaaggattatcattgtctgtgattatttgaataaataatttttatgttcattatatgtagtaaatttaggatgtaagcttccagggtttgacactttaaacttgtaaagaaataaaaataattacgctttacttccgata

SEQ ID NO: 2538 - DNA, 1429 bp, Homo sapiens
cccaaatggacactaccatggaagctgacctgggtgccactggccacaggccccgcacagagcttgatgatgaggactcctacccccaaggtggctgggacacggtcttcctggtggccctgctgctccttgggctgccagccaatgggttgatggcgtggctggccggctcccaggcccggcatggagctggcacgcgtctggcgctgctcctgctcagcctggccctctctgacttcttgttcctggcagcagcggccttccagatcctagagatccggcatgggggacactggccgctggggacagctgcctgccgcttctactacttcctatggggcgtgtcctactcctccggcctcttcctgctggccgccctcagcctcgaccgctgcctgctggcgctgtgcccacactggtaccctgggcaccgcccagtccgcctgcccctctgggtctgcgccggtgtctgggtgctggccacactcttcagcgtgccctggctggtcttccccgaggctgccgtctggtggtacgacctggtcatctgcctggacttctgggacagcgaggagctgtcgctgaggatgctggaggtcctggggggcttcctgcctttcctcctgctgctcgtctgccacgtgctcacccaggccacagcctgtcgcacctgccaccgccaacagcagcccgcagcctgccggggcttcgcccgtgtggccaggaccattctgtcagcctatgtggtcctgaggctgccctaccagctggcccagctgctctacctggccttcctgtgggacgtctactctggctacctgctctgggaggccctggtctactccgactacctgatcctactcaacagctgcctcagccccttcctctgcctcatggccagtgccgacctccggaccctgctgcgctccgtgctctcgtccttcgcggcagctctctgcgaggagcggccgggcagcttcacgcccactgagccacagacccagctagattctgagggtccaactctgccagagccgatggcagaggcccagtcacagatggatcctgtggcccagcctcaggtgaaccccacactccagccacgatcggatcccacagctcagccacagctgaaccctacggcccagccacagtcggatcccacagcccagccacagctgaacctcatggcccagccacagtcagattctgtggcccagccacaggcagacactaacgtccagacccctgcacctgctgccagttctgtgcccagtccctgtgatgaagcttccccaaccccatcctcgcatcctaccccaggggcccttgaggacccagccacacctcctgcctctgaaggagaaagccccagcagcaccccgccagaggcggccccgggcgcaggccccacgtgagggtccaggaa

SEQ ID NO: 2539 - DNA, 3930 bp, Homo sapiens
cccaccttactttatcggaacgtgcctaagctgctgcagctggcacccggttgcgctcggcgaagagggctgggggcgggagatgacggtggtcttctccctgcttggcaccctgcgagcaccagctcccttctcctcgccactccaaggttgcagacgaagcaggtactgtcctagatgttaaggacacaacattgagcaaaaacatgcatagtccctgcttccgtgacacttgagtgaactgaatgtgcaaagtccctgtggcacaaagtccctggggccagtgtgtgtggcgggtgtagaaggagctaaagagatctggttggagttggagggtgagagaaaatgaattctaatttacctgcagagaacttaaccattgcagtcaatatgaccaagactttgcctacagcagtaacgcatggatttaattccactaatgacccaccttcaatgtcaattacaaggctttttccagccttactggaatgctttggcattgtcctttgtggctacatagcaggaagggccaatgtcataacatcaacccaggccaaaggactaggaaattttgtctccagatttgcacttccagctttattattcaaaaacatggttgtacttaatttttccaatgtggactggtccttcctatatagtatcttaattgccaaagcttctgtatttttcattgtatgtgtattaaccttattggttgccagtcctgatagtcgatttagcaaagctggactattccctatttttgctacacaaagtaatgactttgcattgggataccctatagttgaagctttatatcaaactacatacccagaatatctccagtacatttatttggtggcaccaatatctcttatgatgttaaaccctatagggtttattttctgtgaaatccaaaagtggaaagacactcaaaatgcttctcaaaataaaataaaaattgtgggactcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattataacctcagggatggtgataagcacatttgtgtctgctcccatcatgtacgtttctgcctggttactgacctttcccactatggaccctaagccattggcatatgccatccagaatgttagttttgatataagtattgtcagcctgatctccttgatctggtctctggctattcttcttttgagtaagaaatataaacagcttcctcatatgcttacaactaatttactcattgctcagtctattgtctgtgctggaatgatgatatggaattttgttaaagaaaaaaattttgttggacaaattttggtgtttgttctattgtacagctccctctatagcacctacctgtggacaggccttctagcaatttctttgtttcttttgaaaaagcgagagagggtacaaattcctgttggaataatcataatatctggctggggaattcctgctctccttgttggtgttcttttgataactggaaaacacaatggagatagcattgactcagccttcttttatggaaaagaacagatgatcaccacagcagtcaccctgttctgcagcatcctgatagctggcatatccctcatgtgcatgaaccagactgcccaagcaggaagctatgaaggtttcgatcagtctcagagccacaaagtggtggagcctggaaatactgcttttgaggagagtccagcaccagtaaatgaaccagaactttttacaagctctattccagaaacaagttgctgctcctgctccatgggaaatggtgaattacactgcccatcaatagagccaatagcaaacacaagcaccagtgagcctgtgattccttcgtttgagaaaaacaatcattgtgtgagtcgctgtaactcccagagctgcatattagcccaggaagaagaacagtatctacagagtggagaccagcaactgacccgacatgtgttgctgtgtttacttctcatcattggcctgttcgctaatctttccagttgtttatggtggctattcaaccaagagcctggaagactttatgttgagttacagtttttctgtgccgtgtttaactttggtcagggatttatttcctttggaatctttggattagataaacatttaatcatcctgcctttcaaaagaagacttgaattcctatggaacaataaagacacagcagaaaacagggattctcctgtttcagaggaaataaaaatgacctgtcaacaatttatccattatcaccgtgacctctgtatccgaaacattgtcaaagaaagaaggtgtggtgcaaagacttctgctggaactttctgtggctgtgacctggtgagctggctaattgaagtcggccttgcctccgaccgtggtgaagctgtgatatacggagacaggctggtacaagggggagtcatccaacatattaccaacgagtatgaattccgggatgagtacttgttttacagatttcttcaaaagagtcctgaacagagtcctcctgctattaatgcaaacactctccaacaggaaagatataaagaaattgagcattcatccccaccctcacattcccctaagacctaaattatgcaggggagaaccctacatggaatcatattctagccgcgtattcattagtttttagctgggtgaccttgggcaagttaacagaggcaacctctctgagcctcagttgtctcttctgtaaaatgtgaaaagatgtgctcccaccacatgcgcagggtctgtgattttacatgtatgtaaaacacataggaagctgacttaggaaaaagagaaaaccaaattaaagttctgataatgaatataatatagtcatcctttagtatccaaggggattggttccaggactcctgaagatcccaaaatctgaggatactcaagtcccttatataaaatggtgtaggccgggcatggtggctcacgcctgtaatcccagtactttgggaggccgagtcaggtggatcacctgaggtcaggagttcaagaccagcctggccaacatggcgaaaccccgtctctactataaaatacaaaaaattagttgggtgtggtggcgggtgcctgtaatcccagctactcaggaggctgaggcaggagaatcgcttgaatctgggaggcagaggttgctgtgagccgagatcgtgccactgcactccagcctgagcaacagagcaagactctatctcaaaaataaaataaaataaaataaaataattaataaaatggtgtagtatttgcatataacctatgcacattctcccatatagtttaatcatctttagatacttataatgcctaatacaatgtaaatgctatgtaaatagttgttgttatactgtattgtttagggaataacaataagaaaaacagtctgtacatgttcactacagatgcaaccattgttaagcctgactacatctttttatctgcggttgattgaatctatggatgtggaacctgtgcatatggagggtcaactgtactataaataatacgaatatgccaacattatataatcattgctttctgcaa

SEQ ID NO: 2540 - DNA, 4876 bp, Homo sapiens
gggggcggggcctcgcggccggcgaggggctgagctgacagggccgcatcggcttaccccaccttactttatcggaacgtgcctaagctgctgcagctggcacccggttgcgctcggcgaagagggctgggggcgggagatgacggtggtcttctccctgcttggcaccctgcgagcaccagctcccttctcctcgccactccaaggttgcagacgaagcagatgtgattataaagacttcagtggaataatcgcaagttcccatgtgagatctggttggagttggagggtgagagaaaatgaattctaatttacctgcagagaacttaaccattgcagtcaatatgaccaagactttgcctacagcagtaacgcatggatttaattccactaatgacccaccttcaatgtcaattacaaggctttttccagccttactggaatgctttggcattgtcctttgtggctacatagcaggaagggccaatgtcataacatcaacccaggccaaaggactaggaaattttgtctccagatttgcacttccagctttattattcaaaaacatggttgtacttaatttttccaatgtggactggtccttcctatatagtatcttaattgccaaagcttctgtatttttcattgtatgtgtattaaccttattggttgccagtcctgatagtcgatttagcaaagctggactattccctatttttgctacacaaagtaatgactttgcattgggataccctatagttgaagctttatatcaaactacatacccagaatatctccagtacatttatttggtggcaccaatatctcttatgatgttaaaccctatagggtttattttctgtgaaatccaaaagtggaaagacactcaaaatgcttctcaaaataaaataaaaattgtgggactcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattataacctcagggatggtgataagcacatttgtgtctgctcccatcatgtacgtttctgcctggttactgacctttcccactatggaccctaagccattggcatatgccatccagaatgttagttttgatataagtattgtcagcctgatctccttgatctggtctctggctattcttcttttgagtaagaaatataaacagcttcctcatatgcttacaactaatttactcattgctcagtctattgtctgtgctggaatgatgatatggaattttgttaaagaaaaaaattttgttggacaaattttggtgtttgttctattgtacagctccctctatagcacctacctgtggacaggccttctagcaatttctttgtttcttttgaaaaagcgagagagggtacaaattcctgttggaataatcataatatctggctggggaattcctgctctccttgttggtgttcttttgataactggaaaacacaatggagatagcattgactcagccttcttttatggaaaagaacagatgatcaccacagcagtcaccctgttctgcagcatcctgatagctggcatatccctcatgtgcatgaaccagactgcccaagcaggaagctatgaaggtttcgatcagtctcagagccacaaagtggtggagcctggaaatactgcttttgaggagagtccagcaccagtaaatgaaccagaactttttacaagctctattccagaaacaagttgctgctcctgctccatgggaaatggtgaattacactgcccatcaatagagccaatagcaaacacaagcaccagtgagcctgtgattccttcgtttgagaaaaacaatcattgtgtgagtcgctgtaactcccagagctgcatattagcccaggaagaagaacagtatctacagagtggagaccagcaactgacccgacatgtgttgctgtgtttacttctcatcattggcctgttcgctaatctttccagttgtttatggtggctattcaaccaagagcctggaagactttatgttgagttacagtttttctgtgccgtgtttaactttggtcagggatttatttcctttggaatctttggattagataaacatttaatcatcctgcctttcaaaagaagacttgaattcctatggaacaataaagacacagcagaaaacagggattctcctgtttcagaggaaataaaaatgacctgtcaacaatttatccattatcaccgtgacctctgtatccgaaacattgtcaaagaaagaaggtgtggtgcaaagacttctgctggaactttctgtggctgtgacctggtgagctggctaattgaagtcggccttgcctccgaccgtggtgaagctgtgatatacggagacaggctggtacaagggggagtcatccaacatattaccaacgagtatgaattccgggatgagtacttgttttacagatttcttcaaaagagtcctgaacagagtcctcctgctattaatgcaaacactctccaacaggaaagatataaagaaattgagcattcatccccaccctcacattcccctaagacctaaattatgcaggggagaaccctacatggaatcatattctagccgcgtattcattagtttttagctgggtgaccttgggcaagttaacagaggcaacctctctgagcctcagttgtctcttctgtaaaatgtgaaaagatgtgctcccaccacatgcgcagggtctgtgattttacatgtatgtaaaacacataggaagctgacttaggaaaaagagaaaaccaaattaaagttctgataatgaatataatatagtcatcctttagtatccaaggggattggttccaggactcctgaagatcccaaaatctgaggatactcaagtcccttatataaaatggtgtaggccgggcatggtggctcacgcctgtaatcccagtactttgggaggccgagtcaggtggatcacctgaggtcaggagttcaagaccagcctggccaacatggcgaaaccccgtctctactataaaatacaaaaaattagttgggtgtggtggcgggtgcctgtaatcccagctactcaggaggctgaggcaggagaatcgcttgaatctgggaggcagaggttgctgtgagccgagatcgtgccactgcactccagcctgagcaacagagcaagactctatctcaaaaataaaataaaataaaataaaataattaataaaatggtgtagtatttgcatataacctatgcacattctcccatatagtttaatcatctttagatacttataatgcctaatacaatgtaaatgctatgtaaatagttgttgttatactgtattgtttagggaataacaataagaaaaacagtctgtacatgttcactacagatgcaaccattgttaagcctgactacatctttttatctgcggttgattgaatctatggatgtggaacctgtgcatatggagggtcaactgtactataaataatacgaatatgccaacattatataatcattgctttctgcaactgtttactataatttcaaaattaatatcctattaactgttcctataaattatcaaatttggcaagtgtattactagcaggagatggaccttaaattatgacaactttatattttttgatagcatctcttgaaaaagaattttaatgattctaataagaggttctttttcttttttccatttccttgacaaatagtactcatttaaaaactagagggctaggcttagtggctcacgcctgtaatctcagcactttgggaggctgaggcgggcagatcgcttgaggtcaggagttcaagaccagcccgggcaacgtggtgaaacccggtctgtactaaaaaaaaaaaaaaagaaaaagaaaaagaaaaaagaatacccaggtgtggtagtgcatgcctgtagtcccagctactttggagactgaggtgggagtaccccttgagcctgggaggcgcaggttgcagtgaaccaagatcacatcactgcacttcaacctgggtgacagagcaagaccctgtctcaaaaacaaaaaacaagcaaaaaaaacctagaggcactatttttttttaaagtttgtcttttcttttctacccaaattactaatctatgccattaaggaaaggaataagaacctccatatgtattattatctccacagtcctgcagaagtacaatctgatctttaactttcatgctacaaataataatttgagtagattaatttgaattttatcaacaaaattattgccatatgatgtatcatttctgtgtttgaacaaagcatcgtaatgcaggataacttctactttattccctgtagttaaaaaaaaaaaaactatatagttcaagccaatatttaaaaattctaaacctaggctgggcatggtgactcatacctgtaatcccagcactttgggaggccgaggcaggtgaattgcttcagcccaggagttcgagaccagcctggccaatgtggtgaaaccccatctctac

SEQ ID NO: 2541 - DNA, 6730 bp, Homo sapiens
gcggccggcgaggggctgagctgacagggccgcatcggcttaccccaccttactttatcggaacgtgcctaagctgctgcagctggcacccggttgcgctcggcgaagagggctgggggcgggagatgacggtggtcttctccctgcttggcaccctgcgagcaccagctcccttctcctcgccactccaaggttgcagacgaagcagagatctggttggagttggagggtgagagaaaatgaattctaatttacctgcagagaacttaaccattgcagtcaatatgaccaagactttgcctacagcagtaacgcatggatttaattccactaatgacccaccttcaatgtcaattacaaggctttttccagccttactggaatgctttggcattgtcctttgtggctacatagcaggaagggccaatgtcataacatcaacccaggccaaaggactaggaaattttgtctccagatttgcacttccagctttattattcaaaaacatggttgtacttaatttttccaatgtggactggtccttcctatatagtatcttaattgccaaagcttctgtatttttcattgtatgtgtattaaccttattggttgccagtcctgatagtcgatttagcaaagctggactattccctatttttgctacacaaagtaatgactttgcattgggataccctatagttgaagctttatatcaaactacatacccagaatatctccagtacatttatttggtggcaccaatatctcttatgatgttaaaccctatagggtttattttctgtgaaatccaaaagtggaaagacactcaaaatgcttctcaaaataaaataaaaattgtgggactcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattataacctcagggatggtgataagcacatttgtgtctgctcccatcatgtacgtttctgcctggttactgacctttcccactatggaccctaagccattggcatatgccatccagaatgttagttttgatataagtattgtcagcctgatctccttgatctggtctctggctattcttcttttgagtaagaaatataaacagcttcctcatatgcttacaactaatttactcattgctcagtctattgtctgtgctggaatgatgatatggaattttgttaaagaaaaaaattttgttggacaaattttggtgtttgttctattgtacagctccctctatagcacctacctgtggacaggccttctagcaatttctttgtttcttttgaaaaagcgagagagggtacaaattcctgttggaataatcataatatctggctggggaattcctgctctccttgttggtgttcttttgataactggaaaacacaatggagatagcattgactcagccttcttttatggaaaagaacagatgatcaccacagcagtcaccctgttctgcagcatcctgatagctggcatatccctcatgtgcatgaaccagactgcccaagcaggaagctatgaaggtttcgatcagtctcagagccacaaagtggtggagcctggaaatactgcttttgaggagagtccagcaccagtaaatgaaccagaactttttacaagctctattccagaaacaagttgctgctcctgctccatgggaaatggtgaattacactgcccatcaatagagccaatagcaaacacaagcaccagtgagcctgtgattccttcgtttgagaaaaacaatcattgtgtgagtcgctgtaactcccagagctgcatattagcccaggaagaagaacagtatctacagagtggagaccagcaactgacccgacatgtgttgctgtgtttacttctcatcattggcctgttcgctaatctttccagttgtttatggtggctattcaaccaagagcctggaagactttatgttgagttacagtttttctgtgccgtgtttaactttggtcagggatttatttcctttggaatctttggattagataaacatttaatcatcctgcctttcaaaagaagacttgaattcctatggaacaataaagacacagcagaaaacagggattctcctgtttcagaggaaataaaaatgacctgtcaacaatttatccattatcaccgtgacctctgtatccgaaacattgtcaaagaaagaaggtgtggtgcaaagacttctgctggaactttctgtggctgtgacctggtgagctggctaattgaagtcggccttgcctccgaccgtggtgaagctgtgatatacggagacaggctggtacaagggggagtcatccaacatattaccaacgagtatgaattccgggatgagtacttgttttacagatttcttcaaaagagtcctgaacagagtcctcctgctattaatgcaaacactctccaacaggaaagatataaagaaattgagcattcatccccaccctcacattcccctaagacctaaattatgcaggggagaaccctacatggaatcatattctagccgcgtattcattagtttttagctgggtgaccttgggcaagttaacagaggcaacctctctgagcctcagttgtctcttctgtaaaatgtgaaaagatgtgctcccaccacatgcgcagggtctgtgattttacatgtatgtaaaacacataggaagctgacttaggaaaaagagaaaaccaaattaaagttctgataatgaatataatatagtcatcctttagtatccaaggggattggttccaggactcctgaagatcccaaaatctgaggatactcaagtcccttatataaaatggtgtaggccgggcatggtggctcacgcctgtaatcccagtactttgggaggccgagtcaggtggatcacctgaggtcaggagttcaagaccagcctggccaacatggcgaaaccccgtctctactataaaatacaaaaaattagttgggtgtggtggcgggtgcctgtaatcccagctactcaggaggctgaggcaggagaatcgcttgaatctgggaggcagaggttgctgtgagccgagatcgtgccactgcactccagcctgagcaacagagcaagactctatctcaaaaataaaataaaataaaataaaataattaataaaatggtgtagtatttgcatataacctatgcacattctcccatatagtttaatcatctttagatacttataatgcctaatacaatgtaaatgctatgtaaatagttgttgttatactgtattgtttagggaataacaataagaaaaacagtctgtacatgttcactacagatgcaaccattgttaagcctgactacatctttttatctgcggttgattgaatctatggatgtggaacctgtgcatatggagggtcaactgtactataaataatacgaatatgccaacattatataatcattgctttctgcaactgtttactataatttcaaaattaatatcctattaactgttcctataaattatcaaatttggcaagtgtattactagcaggagatggaccttaaattatgacaactttatattttttgatagcatctcttgaaaaagaattttaatgattctaataagaggttctttttcttttttccatttccttgacaaatagtactcatttaaaaactagagggctaggcttagtggctcacgcctgtaatctcagcactttgggaggctgaggcgggcagatcgcttgaggtcaggagttcaagaccagcccgggcaacgtggtgaaacccggtctgtactaaaaaaaaaaaaaaagaaaaagaaaaagaaaaaagaatacccaggtgtggtagtgcatgcctgtagtcccagctactttggagactgaggtgggagtaccccttgagcctgggaggcgcaggttgcagtgaaccaagatcacatcactgcacttcaacctgggtgacagagcaagaccctgtctcaaaaacaaaaaacaagcaaaaaaaacctagaggcactatttttttttaaagtttgtcttttcttttctacccaaattactaatctatgccattaaggaaaggaataagaacctccatatgtattattatctccacagtcctgcagaagtacaatctgatctttaactttcatgctacaaataataatttgagtagattaatttgaattttatcaacaaaattattgccatatgatgtatcatttctgtgtttgaacaaagcatcgtaatgcaggataacttctactttattccctgtagttaaaaaaaaaaaaactatatagttcaagccaatatttaaaaattctaaacctaggctgggcatggtgactcatacctgtaatcccagcactttgggaggccgaggcaggtgaattgcttcagcccaggagttcgagaccagcctggccaatgtggtgaaaccccatctctactaaaaaaaaaaaaaaaaaaaaaaattagccaggtgtggtggtgtgcacctgtaatcccagctacccaggaggctgaggcaggaaaattgcttgaaaccaggaggcagaggttgcagtgagctgagatcgtgccactgcactccagcctgagtgtcagagtgagactctgtctcagaaaaaaaaaaaaaaattctaaagattacatttagaatttagtctttttaaagtgtccatgtataaaaatatataatttttaaaattactaaatgttgccttttctcttagtctaatattttagctactaaaacaaaatataaactggatagcttataaacaacataaacttatttctcacagttttggaggctgtgaagtccaagattaaggcactaacagatctagtgtctggtaaggcaaatttctggctcatagatggtaccttcttgctgtgtccccacatggtagatgggaagaactggtctcattggccccttataaggacattaattccactcaataggctccaccctcatgatctaataacctctcaaaggccctacctcctaatactaacacattgaggatgtgacttcaactttacatttctacaggcagagaagtggggctgtgtaaattcttcccatcagtacttgaatgttcatttaacaaataacttatcgagcatctagcatgttccagacacaatctgaacactgagcacacaacagttggaacaaatatgattcctatcctcatggagcttctattctcctgtgaaaaacagatgttaaacatgattgaggattaggtttcaacataagaattctaggaggacacagacatttagaccatagcatcttcaggtaaactttatcttcagtaaattaaagagatctatttagatgacctttgagcatcttaattattagatgtcagtgctagtttaacttattttaaacgtttcagatatttatttaattatactttaagtgtctcatgtaaaaaagttatttataaaataatttatagggttagagtcattgcccttttaatgcaacaaataaacagttttttaaaaacctgcatgggggccaggcgcggtggttcatacctgcaatcccagcactttgggaggtcgaggctggcggatcacgaggtcaggagatcgagaccaccctgattaatgcggtgaaatcccgtctctactaaaaatacaaaaaattagccagacgtggtggtgggcacctatagtcccagctactcgggaggctgaggcaggagaatggcatgaacccggaaggcggagcttgcagtgaaccaagatcgcgccactgcactccagcctgggcgacagagtgagactccatcgcaaaaaaaaaaaaaaaaaaacctgcatggaagcctagtatatttattaataacaaataaattatactttagtgtactattaacctataccaattttaagttgtgattagggaatggggatgtttttaagctgaattgtcttgctgcggaactttccttttttaataagaccatattatgactctgaatgctcaagggtaagtctaaggcctcattgctgttaccaggagatttttctagttacagtaataaagatgttaattcacatgcatgcagacaactgaaactcaagtggagaatttgtttgtgaacaagtcatactacttctgttatttgcatgaatggaatctgcaatatctttttccatgggagaccctaaaagaaaaccctggatcagaatgatctgcagtttcagataataaaggcttttaagagacatttttagaattaaaaatatgctaattttattaaatgaaaatatttgtaactgttaactttctcactgacaaagcaagtttctcaataaaatacctattttaacttgca

SEQ ID NO: 2542 - DNA, 6050 bp, Homo sapiens
ctttatcggaacgtgcctaagctgctgcagctggcacccggttgcgctcggcgaagagggctgggggcgggagatgacggtggtcttctccctgcttggcaccctgcgagcaccagctcccttctcctcgccactccaaggttgcagacgaagcagagatctggttggagttggagggtgagagaaaatgaattctaatttacctgcagagaacttaaccattgcagtcaatatgaccaagactttgcctacagcagtaacgcatggatttaattccactaatgacccaccttcaatgtcaattacaaggctttttccagccttactggaatgctttggcattgtcctttgtggctacatagcaggaagggccaatgtcataacatcaacccaggccaaaggactaggaaattttgtctccagatttgcacttccagctttattattcaaaaacatggttgtacttaatttttccaatgtggactggtccttcctatatagtatcttaattgccaaagcttctgtatttttcattgtatgtgtattaaccttattggttgccagtcctgatagtcgatttagcaaagctggactattccctatttttgctacacaaagtaatgactttgcattgggataccctatagttgaagctttatatcaaactacatacccagaatatctccagtacatttatttggtggcaccaatatctcttatgatgttaaaccctatagggtttattttctgtgaaatccaaaagtggaaagacactcaaaatgcttctcaaaataaaataaaaattgtgggactcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattataacctcagggatggtgataagcacatttgtgtctgctcccatcatgtacgtttctgcctggttactgacctttcccactatggaccctaagccattggcatatgccatccagaatgttagttttgatataagtattgtcagcctgatctccttgtctattgtctgtgctggaatgatgatatggaattttgttaaagaaaaaaattttgttggacaaattttggtgtttgttctattgtacagctccctctatagcacctacctgtggacaggccttctagcaatttctttgtttcttttgaaaaagcgagagagggtacaaattcctgttggaataatcataatatctggctggggaattcctgctctccttgttggtgttcttttgataactggaaaacacaatggagatagcattgactcagccttcttttatggaaaagaacagatgatcaccacagcagtcaccctgttctgcagcatcctgatagctggcatatccctcatgtgcatgaaccagactgcccaagcaggaagctatgaaggtttcgatcagtctcagagccacaaagtggtggagcctggaaatactgcttttgaggagagtccagcaccagtaaatgaaccagaactttttacaagctctattccagaaacaagttgctgctcctgctccatgggaaatggtgaattacactgcccatcaatagagccaatagcaaacacaagcaccagtgagcctgtgattccttcgtttgagaaaaacaatcattgtgtgagtcgctgtaactcccagagctgcatattagcccaggaagaagaacagtatctacagagtggagaccagcaactgacccgacatgtgttgctgtgtttacttctcatcattggcctgttcgctaatctttccagttgtttatggtggctattcaaccaagagcctggaagactttatgttgagttacagtttttctgtgccgtgtttaactttggtcagggatttatttcctttggaatctttggattagataaacatttaatcatcctgcctttcaaaagaagacttgaattcctatggaacaataaagacacagcagaaaacagggattctcctgtttcagaggaaataaaaatgacctgtcaacaatttatccattatcaccgtgacctctgtatccgaaacattgtcaaagaaagaaggtgtggtgcaaagacttctgctggaactttctgtggctgtgacctggtgagctggctaattgaagtcggccttgcctccgaccgtggtgaagctgtgatatacggagacaggctggtacaagggggagtcatccaacatattaccaacgagtatgaattccgggatgagtacttgttttacagatttcttcaaaagagtcctgaacagagtcctcctgctattaatgcaaacactctccaacaggaaagatataaagaaattgagcattcatccccaccctcacattcccctaagacctaaattatgcaggggagaaccctacatggaatcatattctagccgcgtattcattagtttttagctgggtgaccttgggcaagttaacagaggcaacctctctgagcctcagttgtctcttctgtaaaatgtgaaaagatgtgctcccaccacatgcgcagggtctgtgattttacatgtatgtaaaacacataggaagctgacttaggaaaaagagaaaaccaaattaaagttctgataatgaatataatatagtcatcctttagtatccaaggggattggttccaggactcctgaagatcccaaaatctgaggatactcaagtcccttatataaaatggtgtaggccgggcatggtggctcacgcctgtaatcccagtactttgggaggccgagtcaggtggatcacctgaggtcaggagttcaagaccagcctggccaacatggcgaaaccccgtctctactataaaatacaaaaaattagttgggtgtggtggcgggtgcctgtaatcccagctactcaggaggctgaggcaggagaatcgcttgaatctgggaggcagaggttgctgtgagccgagatcgtgccactgcactccagcctgagcaacagagcaagactctatctcaaaaataaaataaaataaaataaaataattaataaaatggtgtagtatttgcatataacctatgcacattctcccatatagtttaatcatctttagatacttataatgcctaatacaatgtaaatgctatgtaaatagttgttgttatactgtattgtttagggaataacaataagaaaaacagtctgtacatgttcactacagatgcaaccattgttaagcctgactacatctttttatctgcggttgattgaatctatggatgtggaacctgtgcatatggagggtcaactgtactataaataatacgaatatgccaacattatataatcattgctttctgcaactgtttactataatttcaaaattaatatcctattaactgttcctataaattatcaaatttggcaagtgtattactagcaggagatggaccttaaattatgacaactttatattttttgatagcatctcttgaaaaagaattttaatgattctaataagaggttctttttcttttttccatttccttgacaaatagtactcatttaaaaactagagggctaggcttagtggctcacgcctgtaatctcagcactttgggaggctgaggcgggcagatcgcttgaggtcaggagttcaagaccagcccgggcaacgtggtgaaacccggtctgtactaaaaaaaaaaaaaaagaaaaagaaaaagaaaaaagaatacccaggtgtggtagtgcatgcctgtagtcccagctactttggagactgaggtgggagtaccccttgagcctgggaggcgcaggttgcagtgaaccaagatcacatcactgcacttcaacctgggtgacagagcaagaccctgtctcaaaaacaaaaaacaagcaaaaaaaacctagaggcactatttttttttaaagtttgtcttttcttttctacccaaattactaatctatgccattaaggaaaggaataagaacctccatatgtattattatctccacagtcctgcagaagtacaatctgatctttaactttcatgctacaaataataatttgagtagattaatttgaattttatcaacaaaattattgccatatgatgtatcatttctgtgtttgaacaaagcatcgtaatgcaggataacttctactttattccctgtagttaaaaaaaaaaaaactatatagttcaagccaatatttaaaaattctaaacctaggctgggcatggtgactcatacctgtaatcccagcactttgggaggccgaggcaggtgaattgcttcagcccaggagttcgagaccagcctggccaatgtggtgaaaccccatctctactaaaaaaaaaaaaaaaaaaaaaaattagccaggtgtggtggtgtgcacctgtaatcccagctacccaggaggctgaggcaggaaaattgcttgaaaccaggaggcagaggttgcagtgagctgagatcgtgccactgcactccagcctgagtgtcagagtgagactctgtctcagaaaaaaaaaaaaaaattctaaagattacatttagaatttagtctttttaaagtgtccatgtataaaaatatataatttttaaaattactaaatgttgccttttctcttagtctaatattttagctactaaaacaaaatataaactggatagcttataaacaacataaacttatttctcacagttttggaggctgtgaagtccaagattaaggcactaacagatctagtgtctggtaaggcaaatttctggctcatagatggtaccttcttgctgtgtccccacatggtagatgggaagaactggtctcattggccccttataaggacattaattccactcaataggctccaccctcatgatctaataacctctcaaaggccctacctcctaatactaacacattgaggatgtgacttcaactttacatttctacaggcagagaagtggggctgtgtaaattcttcccatcagtacttgaatgttcatttaacaaataacttatcgagcatctagcatgttccagacacaatctgaacactgagcacacaacagttggaacaaatatgattcctatcctcatggagcttctattctcctgtgaaaaacagatgttaaacatgattgaggattaggtttcaacataagaattctaggaggacacagacatttagaccatagcatcttcaggtaaactttatcttcagtaaattaaagagatctatttagatgacctttgagcatcttaattattagatgtcagtgctagtttaacttattttaaacgtttcagatatttatttaattatactttaagtgtctcatgtaaaaaagttatttataaaataatttatagggttagagtcattgcccttttaatgcaacaaataaacagttttttaaaaacctgcatgggggccaggcgcggtggttcatacctgcaatcccagcactttgggaggtcgaggctggcggatcacgaggtcaggagatcgagaccaccctgattaatgcggtgaaatcccgtctctactaaaaatacaaaaaattagccagacgtggtggtgggcacctatagtcccagctactcgggaggctgaggcaggagaatggcatgaacccggaaggcggagcttgcagtgaaccaagatcgcgccactgcactccagcctgggcgacagagtgagactccatcgc

SEQ ID NO: 2543 - DNA, 1395 bp, Homo sapiens
ttcagggcccggggcccagatgggcgggggagcggccggacgcgggcggggcgggcgcctggacgcgagcctagggcgcctcggtgcccagacggcggcggcgtggccgcacgcgcggcccggcttctgtcctcgcggcgctccggctcctggccccccacgcacgccctgtggcccgacctgcgcagccgggcacggcgcctgctgctcttcctgtcgctggccgacctgctctcggcgcgctgtccaccttcgccaacaccagctccttcttctggaccgtggccattgcgctctacttgtacctcagcatcgtccgcgccgcgcgcgggcctcgcacagatcgcctgctttgggccttccatgtcgtcagctggggggtcccgttggtcatcactgtggcagccgtcgccctgaagaagattggctatgacgcctcggacgtgtctgtgggctggtgctggatcgacctggaggccaaggaccatgtcctgtggatgctgctgacggggaagctgtgggagatgctggcatatgtgctgctgcctctgctgtacctcctggtccggaagcacatcaacagagcgcacacggcactctctgagtaccggcccatcctctcccaggagcaccgcctgctgcgccactcctccatggcggacaagaagctggtgctcatcccgctcatcttcatcggcctcagggtctggagcaccgtgcggttcgtgctgaccctctgtggctccccggccgtgcagacgccggtgctggtggttctgcatggtatcgggaacacgtttcagggaggtgccaactgcatcatgttcgtcctctgcacccgcgccgtccgaactcggctcttctctctctgttgctgctgctgctcttctcagcctcccaccaagagcccggctggcactcccaaggctcccgcgccttccaagccaggagaatctcaggaatcccaagggaccccaggggaacttccaagcacctgagcttttgtcctttctagttctgtgcataggtgctgccttcctgggggtaggcacttctgtgagtccctgctgcaggggcagaagtgcatgtctgctgcaccagaagcccccgctattgatgctctcggctccattgggagagcagctgccaactcagcttcttctacctcctagatcctcaggcagcaagttccaccggtaccagcgtcctggcccacgggtgggcgttcatctgcataagggtagcagtgagattcgggaagccggtggcccacagctgtggccacagtgcccccacccagtggaccttgatgtcctgaggaccacacagcactgtttacaatctgagggacccacatctgtgcacctatcctctgtgtgattaaataagctgtca

SEQ ID NO: 2544 - DNA, 5265 bp, Homo sapiens
gggcgggggagcggccggacgcgggcggggcgggcgcctggacgcgagcctagggcgcctcggtgcccagacggcggcggcgtggccgcacgcgcggcccggcttctgtcctcgcggcgctccggctcctggccccccacgccatgcagccgtccccgccgcccaccgagctggtgccgtcggagcgcgccgtggtgctgctgtcgtgcgcactctccgcgctcggctcgggcctgctggtggccacgcacgccctgtggcccgacctgcgcagccgggcacggcgcctgctgctcttcctgtcgctggccgacctgctctcggccgcctcctacttctacggagtgctgcagaacttcgcgggcccgtcgtgggactgcgtgctgcagggcgcgctgtccaccttcgccaacaccagctccttcttctggaccgtggccattgcgctctacttgtacctcagcatcgtccgcgccgcgcgcgggcctcgcacagatcgcctgctttgggccttccatgtcgtcagctggggggtcccgttggtcatcactgtggcagccgtcgccctgaagaagattggctatgacgcctcggacgtgtctgtgggctggtgctggatcgacctggaggccaaggaccatgtcctgtggatgctgctgacggggaagctgtgggagatgctggcatatgtgctgctgcctctgctgtacctcctggtccggaagcacatcaacagagcgcacacggcactctctgagtaccggcccatcctctcccaggagcaccgcctgctgcgccactcctccatggcggacaagaagctggtgctcatcccgctcatcttcatcggcctcagggtctggagcaccgtgcggttcgtgctgaccctctgtggctccccggccgtgcagacgccggtgctggtggttctgcatggtatcgggaacacgtttcagggaggtgccaactgcatcatgttcgtcctctgcacccgcgccgtccgaactcggctcttctctctctgttgctgctgctgctcttctcagcctcccaccaagagcccggctggcactcccaaggctcccgcgccttccaagccaggagaatctcaggaatcccaagggaccccaggggaacttccaagcacctgagcttttgtcctttctagttctgtgcataggtgctgccttcctgggggtaggcacttctgtgagtccctgctgcaggggcagaagtgcatgtctgctgcaccagaagcccccgctattgatgctctcggctccattgggagagcagctgccaactcagcttcttctacctcctagatcctcaggcagcaagttccaccggtaccagcgtcctggcccacgggtgggcgttcatctgcataagggtagcagtgagattcgggaagccggtggcccacagctgtggccacagtgcccccacccagtggaccttgatgtcctgaggaccacacagcactgtttacaatctgagggacccacatctgtgcacctatcctctgtgtgattaaataagctgtcaggggccctcagagatgtgtccccatccacacatcatggagcagattcccggctggtcagggtgttaagattctctggagaacccggctttccttggagactttgctcaacagaggaaccagttgccattcaccaggttgaaggttcccctgaggttgcatggtgaccaccaggggcaagcacagcccggcgcagctgctcagggacagcagtctccccgggcctcctggcctctccctccatgggctgctaacccttgccgtagcttgggtttgagtgtcaagcacaggccagaatccacactcctgtccccacctgtcaatcacttcagacacaggttccctccttccaattccaaagctggaacaagggcaggaagaggcgtctcagggaacccccgaagaccccactgtctctccagctcctttcttagaatcctcctcttcttggggagaccaaaggggatgagtagggaggggttctggcttatttacttcttagtttagttttttgtaagtaaagtggccggagagatgagtaatccaaatacgattcctcaggccgggcacagtggctcacacctgtaaccctagcactttgggaggccaaggcaggcagatcacctgaggtcaggagttcaagaccagcctggccaacatggtgaaaccctgtctctactaaaaatacaaaaattagccaggcatggtgatgcacgtctgtaatcccaggtctttgggaggctgaggcaggagaatctcttgaacctgggaggcggaggttgcggtgagccaagaccacaccattgcactccagcctgggcaacaagagtgaaactcggtctcaaacaaacaaatacgatttcttcctaaaggtgaaggttttaagcttcagagtcagtttttttttttttttttttttaaaaaaggagcctcattctgtcgcccggagctgatgtggtggtgcgtgcctgtagtccctactactcaggaggctgagacgggaggatcccttgagcccagggatttgaggcttcattgaactgggatggcaccactgccactccagcctgggcaacagcaggaccctgtctcaaaaaaagaaaaaaacaaaggattcaaaaggattcagctgttttgtattcagctgaggtaagtggcggcatggagcatggagcgattatttacatttaaaagaaaagaattgaaagtaagcacctgtatctctatttttattctgtgggtcttccacaaacgctttcgtcttatttcagaaaacagcttctgtgttcagtcacaggagccatcggcaaagaatggaagtggaaatgctacctccagggtcttggtgagagaaagtacagctttacctgataggtgatttcccttggaatccatcagaactcgacaaagcatgattttctgagcctagtaaaatggttctgaatcaaaaccgaagtcacgctgtgctgccgatccctgtttgactctcaaaaccaaaatctgtatcaggaaaggaataatcatttagcagactgagtccaaaatgctcatttttggtttcctgtgaaaatggatttctttttgtcgctttctttttttttttttttttttttgagatggagtctcactctattgcccaggctggagtgcagtggtgcaattttgactcactgcaaccaccgcctcccaggttcaagcgattctcctgcttcccaatcccaagctgctgggattacaggcatgcgccaccatgctcggctaattttttgtattttcagtagagacgggttttcaccatgttggccaggctggtctcgaactcctgacctcaggtgatccacccacctcagcctcccaaaatgcttcgattgcaggcatgagccactgtgcctgtccaagaaaacagatttcttgatggaaattagtgagacagacatccccttaggattgaaagagagctctgggctgctccagggaaagccacttggcagaaatagcctctgtaagtgaattctggattcccctgaagacgttacagcaaatctctgggtatgtctctggtaaagaccctcacttgagcttctagaagggagcgaaaattcaggaatttgcttgctgcaaaagagaacatgattaacaggtaaaagagaaaagacaatataggccacagaggaatagtgttaggatcaaccctgctcagcaggggcctctggagccctccctgctgtacccaagccagagctgagacatggctccccagatggactggctgtggtcaggaaaggcctgtagagggagctgagggctcagaaaatacctgctccgggtgcctgggctcaagttctcattccatttctttgatgccactggccactgtatctgcttttgtaaaaacctccaaaaagttatacatcaggtatctctagtcagcttcctccgctgcccacctcttgccacagatgagtgatcactgtgaatggtggtgaccaggtgggcagggcaggggcttgtctaagtgccttagcccaggcccctggcccatcgacctcgaaaacagcaatatcgcctccttcttagatccagttaccaagtcagtctagctgggtgggtagtgctcagacagaaaggctggatgggaaggaagtcacatcctaaaagtccaggagggggccaggcgcagtggctcacgcctgtaatcccagcactttgggagaccaaggtgggcagatcacctgaggtcaggagtttgagaccagcctggccaacatggtgaaaccctgtttctactaaatatacaaaaaaaaaaaaaatagttggatgtggtttcgtgtgcctgtagtgccagctactcaggaggctgaggcaggagaattgcttgaacccagaaggcagaggttgcagtgagccgagactgcaccactgcactccagcctgggtgacagagcaagactccatctcaaaaaataaaacaagtccaggaggggctgttacttctttttagtttatttatttttgtgaggcagggttttgctgtctggagcatcatacccagtctggagtgcagtgatgcaatcatggctcactgcagcctccacctcccaggctcaagcgatcctcccacctcagctccctgagaagctgggaccacaggcctggctaaattttgactttttgtagagacaaggttttgccatgttgcccagtcagatctcaagcgaggggctgttacatctgatcagggcaaaaggggctgtgctccttggacactttgcacagccccagtgggcttctttctcctctgttagtgtggttaatgttcatctgcctgcatccctgagtcacccaagtgtaacctcagccataacacgtactgcagccggaacggtgtccgcagctcagcgtccctctcccatgcactttctgaactttggtcttttaaccaggtttaccagccgctttctgcctctttgtgcttttgagggttttttggtttgtttgttctgttttgtttttaaataaagatgattatttggcccaggctgagggtgcaaacagaactcttcacgtgtccacgacaagaaaaatagtttttacaaacttctagttgtggcatcaaaagtgtgagtttttgcacctgcaaaattgtaatgcaagccctgactgggtggaagctgaagtcttgctgttttaaattaaataaataaattatttttctccta

SEQ ID NO: 2545 - DNA, 998 bp, Homo sapiens
agcctagggcgcctcggtgcccagacggcggcggcgtggccgcacgcgcggcccggcttctgtcctcgcggcgctccggctcctggccccccacgccatgcagccgtccccgccgcccaccgagctggtgccgtcggagcgcgccgtggtgctgctgtcgtgcgcactctccgcgctcggctcgggcctgctggtggccacgcacgccctgtggcccgacctgcgcagccgggcacggcgcctgctgctcttcctgtcgctggccgacctgctctcggccgcctcctacttctacggagtgctgcagaacttcgcgggcccgtcgtgggactgcgtgctgcagggcgcgctgtccaccttcgccaacaccagctccttcttctggaccgtggccattgcgctctacttgtacctcagcatcgtccgcgccgcgcgcgggcctcgcacagatcgcctgctttgggccttccatgtcgtcagctggggggtcccgttggtcatcactgtggcagccgtcgccctgaagaagattggctatgacgcctcggacgtgtctgtgggctggtgctggatcgacctggaggccaaggaccatgtcctgtggatgctgctgacggggaagctgtgggagatgctggcatatgtgctgctgcctctgctgtacctcctggtccggaagcacatcaacagagcgggtatcgggaacacgtttcagggaggtgccaactgcatcatgttcgtcctctgcacccgcgccgtccgaactcggctcttctctctctgttgctgctgctgctcttctcagcctcccaccaagagcccggctggcactcccaaggctcccgcgccttccaagccaggagaatctcaggaatcccaagggaccccaggggaacttccaagcacctgagcttttgtcctttctagttctgtgcataggtgctgccttcctgggggtaggcacttctgtgagtccctgctgcaggggcagaagtgca

SEQ ID NO: 2546 - DNA, 6959 bp, Homo sapiens
aatgagagcggcggtggcggcagccgggccgagagacggactcgggctgactccagccgctgggagcgcgaggccatgtaacccgctcggctccaggctgcgaggtgcgtaatccccagccggcccctcgcgcagcgggcacggccagcgctgccacaggtgacttgatttctgcgacggtagcttagccacccggggccaatctcgaaacattcttattttcaagtcctttggactgggtgccatctggagaagggggaagactcctcgaaaaagtctgactgttgagaaactgacgatccaaatttaaaaagtgattcccccccctcccgttccctcctcttctctctgggaggcagatgggagccatggcttaccccttactcctctgcctcctgcttgctcagctgggattgggagctgttggcgccagccgcgacccccaaggacggccggattcccctcgagagaggaccccgaaggggaagccgcacgcccagcagccgggtcgagcctctgcctcggactcctcggctccctggagccgctccaccgatggcaccatcttggcgcagaaactcgccgaggaggtgcccatggacgtggcctcttacctctacaccggggactcccaccagctgaagcgagccaactgctccggccgctacgagttggcgggcctgccggggaagtggccagccctggccagcgcgcacccctccttgcaccgggcgctggacacactgacacacgccaccaacttcctcaacgtgatgctgcagagcaataagtcgcgggagcagaacttgcaggacgacctggattggtaccaggcgctggtgtggagccttctggagggcgagcccagcatctcccgggcggccatcaccttcagcaccgattcgctgtccgcaccggccccacaggtcttcctccaggccacgcgcgaggagagccgcatcctgctccaagacctgtcctcctccgcaccccacctggccaacgccactctggagaccgagtggttccacggcctccggcgcaagtggaggccccacttacaccgccgcggccccaatcaggggccccggggcctgggccacagctggcggcgcaaggacgggctcggcggggacaagagccacttcaagtggtctccgccttatctggagtgcgagaacgggagttacaagcccgggtggctggttactctttcctctgccatctacgggttgcagcctaacctggtcccggaattcaggggtgtcatgaaagttgacataaatcttcagaaagtggacattgaccaatgctcaagtgatggctggttttcaggaactcataaatgccacctcaacaattcagagtgtatgccaattaaaggcctaggattcgttcttggagcctatgagtgcatttgcaaagcaggattctatcatcctggagtcttaccagtgaacaactttcggagaaggggtccggatcagcatatttcaggaagtacaaaagatgtgtcagaagaagcctatgtctgcctaccttgcagggagggctgccccttctgtgctgatgacagcccatgcttcgtccaggaagataagtatttacgacttgccatcatctccttccaagccctgtgtatgctgctcgacttcgttagcatgctggtggtctaccactttcgcaaagcaaagagcatccgggcatcgggccttatcctgttggaaacgatcctttttggatctctgctcctatactttccagttgttattttgtactttgagccaagcacatttcgctgtattctcctaagatgggctcgtcttctcggttttgctactgtttacggaactgtcactctcaaacttcacagggttttgaaggtgtttctttcacgaacggctcaacgaattccatatatgactggcggacgggtcatgaggatgctggcagtaatactcttggtagtgttttggtttctcattggctggacttcatctgtgtgccagaatttggagaaacagatttcacttattggccaggggaaaacatccgatcacctcatcttcaatatgtgcctcattgaccgctgggactacatgacagcagttgctgaatttttattcctcttgtggggtgtttatctctgctatgcagtgcggacagtcccatcggcattccatgagccccgctatatggctgttgcagttcacaatgagctcatcatctctgctatattccatacaattagatttgttcttgcctcaagacttcagtctgattggatgttgatgctgtattttgcacatactcatttgactgtgacagtcaccattgggttgcttttgattccaaagttttcacattcaagcaataacccacgagatgatattgctacagaagcatatgaggatgagctagacatgggccgatctggatcctacctgaacagcagtatcaattcagcctggagtgagcacagcttggatccagaggacattcgggacgagctgaaaaaactctatgcccaactggaaatatataaaagaaagaagatgatcacaaacaacccccacctccagaaaaagcggtgctcgaagaagggcctaggtcgttccatcatgagacgcattacggagatcccagagacagtcagccggcagtgctctaaagaggacaaggagggcgccgaccatggcacagccaaaggcactgccctcatcaggaagaaccccccagagtcttcagggaacacagggaaatccaaggaggagaccctgaaaaaccgagtcttctcactcaagaaatcccacagcacttatgaccacgtgagagaccaaacggaagagtccagtagcctacccacagaaagccaagaggaggagacaacagaaaattccacactggaatccctgtcgggtaaaaaactaacacaaaaactaaaagaagacagcgaggctgagtccacggagtcggtgccgttggtgtgcaagtcagcaagcgctcacaacctcagctcagagaagaaaactgggcacccacgaacatcgatgttacagaagtctctcagtgtcatagcaagcgccaaggagaagactcttggattagctgggaaaacccaaacagcaggtgtggaagaacgcactaaatcccagaaacctttgccaaaagataaagagacaaacagaaatcactcaaattctgataacacagagactaaagatcctgccccccaaaactcaaatcctgcggaggagccaagaaagcctcagaaatctgggattatgaaacaacaaagggtcaaccccaccactgccaattctgacctgaacccaggcaccacccagatgaaggacaactttgacattggggaggtgtgtccttgggaggtttatgacctgacccctggtcctgtgccttcagaatcaaaagttcaaaagcacgtatctattgtggcttctgaaatggagaaaaaccccactttttccttaaaggagaaatctcaccacaagcctaaggcagctgaggtttgtcagcaatccaatcagaagcgcatagataaggctgaagtatgcctttgggagagccaaggccagtccattttggaagatgagaagcttttgatttccaagactccagttctcccagagagggcaaaagaggagaacggaggtcagcctcgtgcagccaatgtgtgtgctgggcagagcgaagaactgccccccaaagctgtagcatcaaaaacagagaatgaaaatctcaaccaaataggacaccaggaaaaaaagacatcttcttctgaggagaatgtgcgtggctcctataactcaagtaataacttccagcaacctttaacatcacgagcagaggtttgtccttgggagtttgagaccccagctcaaccaaatgctggaagaagtgtagctttacctgcctcttctgctctaagtgcaaataagatagcagggcctaggaaagaagagatctgggatagttttaaagtgtagcatctccaggaagaagaggaaaaggagggaaccccggattggatatgagacagaagatataagaatcaaatattcccaaggaggatttgtcaatcaaggaaaacatgacagatggtgaggtaaagtcaaaggcatgggtagaagaggaccaggggggcaagagcaacaacgtcataatggagaagtcagactttggtcaagaaagtccttcccttggtaacactaggaaaatctttccatttcagcatgtttaaggaaaatagcccacaatgtctgccctgatcaatatgtatccatgggactttgaagatcctaagccaggtaaaccaggagacacagaagacgtaccagatttgcaaagaaagaaaaggtataagacatatataactgaaattctaagtagctgaccgagaagaacttactttacctatttaaccttgatagcactgctaacttaatgcatcccaaaaatatcttttatattaatgattgctctcattttcttataaatgtatgtttcagtatatcgttgtgtctcatattcaagcattccagattgtataatttttgcaaataactttggtattatgtgacacaacacatttatgcaatctgcagctattcaattgttattgcaccttacagaatacctgctatctatcaactttagttgattcttgaagtacagtaagctttctctggcttgggaagccataactgttactataaaaacttttagttttggctgtggtttatatattgtgactttgaatttgactctattatttcacatcatggtttgttatactgtcttaatcagggttttttatacaagttgagttacttgttttgcacttcttgttaggactcagaagctttattaatattggagatcaagtggtcctacttagtcatatgtctcaataagttaaggacaacttatccgttgtttattcaaagtcagagatagataacgccttcattccaattaattgtcccttttaactctttcagtatttcctacttagcagcatttccaaaggaagaagctaagagtgagaaaaatataccgtgcattattattactattggaaagggaagactctagggatgacataagaattatagcagtactataaacccaggaagtttgcctttcaaaaaaaaacacaggtagctcctgatagcactttcaagggattatttttttaaagagaaaaattatggtagcatcaagatcattgtatggatatatttttattatgtgtactgaaaatacagtattttaaaataccttaaagtatttattctcataaactcttattcattgcttcagctacaggtagaacttgctgggctcaaatcccaaagaggttttataaccttatttattcaaaacctataaggtggtatggaatcttcattctcccaagcactggaaaatgtctaagtcctgcaaattgccattgtgagccacttgctcgacatgtaacatgtaaggtccatttgcaaagcaaagcagcccccaaagcatattttataaagcttattgcattccacactgatctcttggcatgggaatcctaagctgccgactaagccctaccgacatgatcatgcagtgagattccaaagctcagtctcatttcatttaaagaagaatcactcagaaatagaaccgagacttccctttttctccctgtaaacacccaagtatcaactgcttatttggccaggacactcccagcacaaataactattttttatgtcacaagcagcaaggaggacatgctagggtgataaaagatggagaaacaggatcagagggtggatatagggctgttcttagagagtattttcagtggaaggtaaaaacagaattctccatattcatcatcaaatttttctcagtgatttttttattcaggagtaagcaagcacttcactgtttcacaaagctgtgcgcaaatcttcctcacccatttgctgactttatgcattactcaggttggtggggtcggtttgagaagatatagaaattctatttttgtgtctttacaccatttatttcttttatctcttccttttcaatgaaggcctatatgcttggtgacctcctttaaggaatctttgtgaactgggttggaagttcctagacccacatatttgtttcatttatgtctgaaatctgttagcacttgattcctttcttgagaattatgcagtcaagcatcagtgactttctattgcacttcaggattgatcctgctagagatgtgagttaaaaagacttgccaaattatatcttagcgacattctatagttcatagattattctccaccagcataaatcagtgagagtgcctagagtctttctgagagtttcattgccattatcaacaagagaagttgaaatttacaagtcaggaggttatttttccagattgataaccatagaaagtgaataaacacttttaaggtcgcaaacatttgctaggttgtccttctcaatgcatgtgcaggctgcatcctgtccttgtttttaagccagggtttataaataagtagatttataccaatcttaatagaattgtatattttatgcaagaattaaatgctttacaacatgaagtataactcaacccattgtaaactttggtggcaatatggatttgaaactcgacagttctcttgtatttgcttcctaggtttctgcatgcaagttatgacaggtaggactgaaaaaacactgccttttgacttctagcatttagcaaccgagagtcgtagagtcaataaagctgtaagtgtcttcacttaatctgtggttctcctaaaactattatctgaaacctacagcatcccaccatgaaatatttggtaaatttatgttgtgacgtgttgcagcatgtaaataattataacttctctgcaataaaacatatttatatg

SEQ ID NO: 2547 - DNA, 2039 bp, Homo sapiens
ccggcccttgtttcgttgggcccggacgggacgtgcgcgctcaaaggttgcccgtctctgacgcccgcatttcctggtctggagccggctgagccacagcagggtcgccgcggggtcccggggccgtgctcccctgcccctcccgggagcgcgcggggcggggcggggcggggcgggaccaggcgggcgagctgggccctcgcccctccctcgggcggtcacctgggcacgggcgctgcaggtgtcggggcctcaaccttgcggagccgacagccatcgatcctcgggtggcctcgaggtggtggcagggccgccccctgcagtccggagacgaacgcacggaccgggcctccggaggcaggttcggctggaaggaaccgctctcgcttcgtcctacacttgcgcaaatgtctccgagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaattttaatttggatttcagtccttgcttatgttttgggagacccagccatctaccaaagcctgaaggcacagaatgcttattctcgtcactgtcctttctatgtcagcattcagagttactggctgtcatttttcatggtgatgattttatttgtagctttcataacctgttgggaagaagttactactttggtacaggctatcaggataacttcctatatgaatgaaactatcttatattttcctttttcatcccactccagttatactgtgagatctaaaaaaatattcttatccaagctcattgtctgttttctcagtacctggttaccatttgtactacttcaggtaatcattgttttacttaaagttcagattccagcatatattgagatgaatattccctggttatactttgtcaatagttttctcattgctacagtgtattggtttaattgtcacaagcttaatttaaaagacattggattacctttggatccatttgtcaactggaagtgctgcttcattccacttacaattcctaatcttgagcaaattgaaaagcctatatcaataatgatttgttaatattattaattaaaagttacagctgtcataagatcataattttatgaacagaaagaactcaggacatattaaaaaataaactgaactaaaacaacttttgccccctgactgatagcatttcagaatgtgtcttttgaagggctatgataccagttattaaatagtgttttattttaaaaacaaaataattccaagaagtttttatagttattcagggacactatattacaaatattactttgttattaacacaaaaagtgataagagttaacatttggctatactgatgtttgtgttactcaaaaaaactactggatgcaaactgttatgtaaatctgagatttcactgacaactttaagatatcaacctaaacatttttattaaatgttcaaatgaaagcaagaaagtaaaaa

SEQ ID NO: 2548 - DNA, 783 bp, Homo sapiens
agagcttactcacatagcatattggtatatcaaaatgaaatgcaaggaaccaaaaataacataattgaaggcagtaaaagtgaaattaaataggaagatcatcagtcaaggaagacccactggagactgaaaccacctgttttcagagcttcaggaaaagacttaatctgaaggatcctgcagctaaaaagctttgaaaactgtgttaaggggccccataagcatcgcttctaaacttcactgacaaaagggactggggtcatgctgtctggagtcagagtgagggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaat

SEQ ID NO: 2549 - DNA, 740 bp, Homo sapiens
ttatcgggctcaccaaatacagctgcagtatgaattccatcttctacacaacagtaaaccagaatgttcatgttcacagcgttcatctcccatcctgttgtctaacgcacatggtttttttaaacttttctaagattgcatgagattctgcaacacaactgattataaaaacacttgaagtttttacctttttttttactttccaactctcgtgaatgtacagaggactttccagaagctacatgatgtgtgatatttcagctgatgaaatgtagatgtatagagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggt

SEQ ID NO: 2550 - DNA, 1299 bp, Homo sapiens
ctcgggcggtcacctgggcacgggcgctgcaggtgtcggggcctcaaccttgcggagccgacagccatcgatcctcgggtggcctcgaggtggtggcagggccgccccctgcagtccggagacgaacgcacggaccgggcctccggaggcaggttcggctggaaggaaccgctctcgcttcgtcctacacttgcgcaaatgtctccggcttgctccacttatcgggctcaccaaatacagctgcagtatgaattccatcttctacacaacagtaaaccagaatgttcatgttcacagcgttcatctcccatcctgttgtctaacgcacatggtttttttaaacttttctaagattgcatgagattctgcaacacaactgattataaaaacacttgaagtttttacctttttttttactttccaactctcgtgaatgtacagaggactttccagaagctacatgatgtgtgatatttcagctgatgaaatgtagatgtataggtaatcggtcagagtggtgggagaaactgttgggaaaggagcaggccttctgaaaggtcggaaggcttcaggggagaataagctgaacgcagctgttctctgaccttgaggcagagggcaaggagtaggtacaaggacgtgtaggagaatttatcttaaataggcttgttcacttgtgttgtccagaaacgacttttgatcatcagcgcgcatgactgctccctgaaaggaagaacaataatgttaattacccgcagactgtgtttgctccaggctttcggcattatgtctgtactgaataaaagcaagcagctccagctgttcgaggctgctctcttcttcagccattagtgccgggcagcccactagctgctgttacactgcatatctgtgtctgagtactcctttcttcagttgcttggccagggtctgtgggacagacccagcagctggtgccctgtgtgaggaacgctgcaatggatcgcgacggaaccctcgaaaacgaagagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatactt

SEQ ID NO: 2551 - DNA, 2768 bp, Homo sapiens
ttccttgcccctcctccccgagtcaccaccgtccagttccccaccctgcactcgtttcccgcccccccccgccccccacaaagctgtcctgccttccctctggcctgggctcactggcaggacgaccccgggagagagggtcctggagagtgagaggggcagagaccgagtgagccgtgggctgagcctgggaggccgggactgagggggaggagggaggcccgggggaagggagggagggagagagggaaggagggaggagggcgggcgagctggagccggcaggcagcgggagcccgagagagccgcgtcgggagtgcggtctccatggcagtgctgggcgcagccggagagagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactggggtgagcctgggggcagcctgcctgctgacagggcgaggattgtggggatcatgggagtgtttgtgagtggggctcctgggtgagacctagcccccacccccacagagctcaagggggtggggggctgaggataggatggctcggggcggggcgggggcagaggaggcctccctgcgctccaacgcattgtcctggctggcctgtgggctcctggcgctgctggccaatgcctggatcatcctcagcatctcggccaagcagcagaagcacaagccactggagctgctgctctgcttcctagcgggcacacacatactcatggcagctgtgcccctcaccacctttgccgtggtgcagctgcgtcgtcaggcttcctccgactatgactggaacgagagtatctgcaaggtcttcgtgtccacctactacaccctggcgctggccacctgcttcacggtcgcctccctctcctaccatcgcatgtggatggtgcgctggcccgtcaactaccgcctcagcaacgccaagaagcaggcactgcatgccgtcatgggcatctggatggtcagcttcatcctctccacactgccctccattggctggcacaacaacggcgagcgctactatgcccgcggctgccagttcatagtctccaagatcggcctcggctttggcgtttgcttcagcctcttgctacttgggggaattgtcatgggtctggtctgtgtggccatcaccttctaccagacactgtgggcccggccccggagggctcggcaggcccggagagtggggggtggtggggggaccaaagcgggtgggccaggggccttgggtacccggccagcttttgaggtaccagccattgtggtggaggatgcccgagggaagcggcggtcctcgctggatggctcggagtctgccaagacatccctgcaggtcaccaacttggtcagcgccatcgtctttctctatgactcactcacaggggtgcccatcttggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatgg

SEQ ID NO: 2552 - DNA, 1610 bp, Homo sapiens
cagagaccgagtgagccgtgggctgagcctgggaggccgggactgagggggaggagggaggcccgggggaagggagggagggagagagggaaggagggaggagggcgggcgagctggagccggcaggcagcgggagcccgagagagccgcgtcgggagtgcggtctccatggcagtgctgggcgcagccggagagagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactggggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatggaaa

SEQ ID NO: 2553 - DNA, 1786 bp, Homo sapiens
ggttgctactgctgcggctaaccaaacagctcatgcttctctgaagacttgcagcaaggcttgctgaggctcacagaagatagccccagtgttttggagtggttttgaatgtgattctgagatcagactgactgagctggaatcctggctttatatcttaccagctacacaaccttggagtcttagaaattttttcttttcaataagcagtcatccttactttccctcaagatgacaaacagttcgttcttctgcccagtttataaagatctggagccattcacgtattttttttatttagttttccttgttggaattattggaagttgttttgcaacctgggcttttatacagaagaatacgaatcacaggtgtgtgagcatctacttaattaatttgcttacagccgatttcctgcttactctggcattaccagtgaaaattgttgttgacttgggtgtggcaccttggaagctgaagatattccactgccaagtaacagcctgcctcatctatatcaatatgtatttatcaattatcttcttagcatttgtcagcattgaccgctgtcttcagctgacacacagctgcaagatctaccgaatacaagaacccggatttgccaaaatgatatcaaccgttgtgtggctaatggtccttcttataatggtgccaaatatgatgattcccatcaaagacatcaaggaaaagtcaaatgtgggttgtatggagtttaaaaaggaatttggaagaaattggcatttgctgacaaatttcatatgtgtagcaatatttttaaatttctcagccatcattttaatatccaattgccttgtaattcgacagctctacagaaacaaagataatgaaaattacccaaatgtgaaaaaggctctcatcaacatacttttagtgaccacgggctacatcatatgctttgttccttaccacattgtccgaatcccgtataccctcagccagacagaagtcataactgattgctcaaccaggatttcactcttcaaagccaaagaggctacactgctcctggctgtgtcgaacctgtgctttgatcctatcctgtactatcacctctcaaaagcattccgctcaaaggtcactgagacttttgcctcacctaaagagaccaaggctcagaaagaaaaattaagatgtgaaaataatgcataaaagacaggattttttgtgctaccaattctggccttactggaccataaagttaattatagctttgaaagataaaaaaaaaaaaaacaaaaaaaaactcagtatgaaaaaatacagttagctagcaaatatggacaggtttacttagaaatcctgtttctaaatgcaagtcaagctttattgttaggcttgctgctactcattaacccaaatatttgtacaaaaaactaaagagtctcattgaacgaatgtaaaatcctgcaatatccttgaaatccaaaagaggtccatgacatagacccaaaggtattcatgagttattcatttaaatgcctggaactgacttcttgataaaaatataaaaaataatttccatgtaagttaccagaaagcccaccagcaacataattttaaagcctttcagattacttttaaaaaatgcagcttacatataacaacttgtgcctattttatttctaatctatcacttcaaaagatggtaatctttcaactcattattcctccaatttttaatgtcgaatttttttctaacacaataaccaaaagcttttatttataaaaaggcttgaaaaatata

SEQ ID NO: 2554 - DNA, 205 bp, Homo sapiens
ctgcaatggggttgctactgctgcggctaaccaaacagctcatgcttctctgaagacttgcagcaaggcttgctgaggctcacagaagatagccccagagtcttagaaattttttcttttcaataagcagtcatccttactttccctcaagatgacaaacagttcgttcttctgcccagtttataaagatctggagccattcacg

SEQ ID NO: 2555 - DNA, 4485 bp, Homo sapiens
accggcagccaggcaggcagacgggtagcaggggccagcactggcccccctcccagcttggcagtggcatgaagatgggagtgggagtgtatagtggaggaagcacctgccgggacccccacctgccagctagttggacaccccaaggctgtgtgctgcccacctggtgttccccaacacccccagccctacccagtgcacccctccggtgcctgctttccctgatgcctgcgatttagaccagcccggctgtatccacggcaacagaagcaggagtgtcactggccgccagatcactgagggtcccacaatgtggcccgggctgtgatttacctgggtgagacagcttgagccccatcgtggattccaagacatccctgctgagagagccaaggtgcaatgtagcaggacaactcatggagcccccccgggcccatcgagtaccggactggctgaccccctagggttggcagtagcccctgaccctcagtatggccaacactaccggagagcctgaggaggtgagcggcgctctgtccccaccgtccgcatcagcttatgtgaagctggtactgctgggactgattatgtgcgtgagcctggcgggtaacgccatcttgtccctgctggtgctcaaggagcgtgccctgcacaaggctccttactacttcctgctggacctgtgcctggccgatggcatacgctctgccgtctgcttcccctttgtgctggcttctgtgcgccacggctcttcatggaccttcagtgcactcagctgcaagattgtggcctttatggccgtgctcttttgcttccatgcggccttcatgctgttctgcatcagcgtcacccgctacatggccatcgcccaccaccgcttctacgccaagcgcatgacactctggacatgcgcggctgtcatctgcatggcctggaccctgtctgtggccatggccttcccacctgtctttgacgtgggcacctacaagtttattcgggaggaggaccagtgcatctttgagcatcgctacttcaaggccaatgacacgctgggcttcatgcttatgttggctgtgctcatggcagctacccatgctgtctacggcaagctgctcctcttcgagtatcgtcaccgcaagatgaagccagtgcagatggtgccagccatcagccagaactggacattccatggtcccggggccaccggccaggctgctgccaactggatcgccggctttggccgtgggcccatgccaccaaccctgctgggtatccggcagaatgggcatgcagccagccggcggctactgggcatggacgaggtcaagggtgaaaagcagctgggccgcatgttctacgcgatcacactgctctttctgctcctctggtcaccctacatcgtggcctgctactggcgagtgtttgtgaaagcctgtgctgtgccccaccgctacctggccactgctgtttggatgagcttcgcccaggctgccgtcaacccaattgtctgcttcctgctcaacaaggacctcaagaagtgcctgaggactcacgccccctgctggggcacaggaggtgccccggctcccagagaaccctactgtgtcatgtgaagcaggctggtaggcagacaggcagagagaaggtcatggccaccgtgatggggccaacagcaagggaggggtaggggcccatacaggagtcctcctttctgagctccagccccagcccctcgaaccacctgtaatctaggcacctttgccaacacctcccaaggatggaggactgggcgagggactgggaaagaggcatatttagttttgtggggcctgtctccgctgcctccttctccacttctacaatctcattctctctctctctctctctgtctctctctctctctctctctctctctcagaagtgacaattcagaaaaagaaaagaacactgagaatgcaggtttttctactaacagctgaggagacaggctttcttactttaatgtctctccttctgacactgtccagaagggggaatttgtcctgtaaaatagacttccagagctcttttgccccctctgctcccatgcaccctccccttccaagtcctttagcaaggcctggatgtttagggagaaagtggtccaaggctgctgacaagagggaccaaagggggtgctgggttcccagggagcagggatgtttaattactatgtcatgtgcaatgttgttttaggccaacccttgccccaagcccagtctcttctccctccccaccatgtccagacctcccaaatggttcttgtgcatctgttggagaagtcaagggagtagggagaagggccccaaggatgggcccaggttaggtgaagagtaagatgtgagctgaactcctcgaactgaagagacccacacttggtcacattctctcacgctgccttcaggatccccagcccccaactcttcttcctgaggatggaaatccactccagccccactaggactgatgtgggtgccatacaggcaggagcagcccaccaggaaagtgtaaggagggagctgaactccccagagtagctggaccacagagacttgggtcagagctgatttcaaccccagaattgtctctcgggttcaccctactcttctgaagatgaaaatttgtttggggccttggtaaccgatagcggtacaaactccaaggcactgtggacttgagtccattcctatctgacctctttttgtccccctcaagcctcaggggcctcaagcccctccttagtagcccttggctgactgggccctgagccccaagcatccttctttcccaacaaccctccttccccatccttcccccacccttacctacacccaaagtggagcacactgcagtcagattctccaggagggagatccaagcctcctcccaggggtggagtccactctgggcttactttgaggcctgttctgtggattggtgagccaagctggcactccttgccctggtcttacccaggctctctgtccccctctcacttcctgtggggccggaatctgtatttatccatccccctttcccttctttatagaagtccctgtcctaaactccctccctagcccaagagagccccagaactggggaagcctgacccatacagaatggggagggcactctaggcaggagagacattaatgagcctggctgcagagtggccctggaaaggcaggccagagtggctgagaggctgggagtaggggagcctgttctctcagcgatagtgatgggggtgcctttccgagggggtggggtgggaagaccaagggggtggggggtagatagggtacatttaggagggttttcctccatttcttttttctaactgcctggattcaccattggattttgtaaatggaaaaactgaaatgaacaatgctatactggatgttttctctttctgactgtgtgtgtgtgtgtgcgtgcgtgcgtgcatgtgccctgtctgaccacatgtggagagacatgattgagtgatagtgtgtgtctgtgtgactttgtgtggggaggcactcctgaagaaaacttgcccggtgcacacacgtaaaatgcctgtatatggggacagatacagcacgtgcatgcatacacacacacacacacacaccacagttgagaggagacaaactagagtatgtgcccgtggtaggaagtcgagtggtcaagagatggatcttggaaactacataggtcggtagcaagagggtagactcccatctcacaagatgggcctcccttggcccaggccctgagcacgggagggctggggccgccagggaacttgaaaacctcatctcctcacaaagcctgtagccccatctcaaccccgtctcagtctccttcccaaactcaaacaaggtgttcctaaaattggaccaccatggagaatggggactgggaattgaggatcaaatgtgagggaaactgatgaggttaggaaatgccccccacaaagtaatggcttctggagggactgctcagtctgggatgggagcccttcctaggggccactgtatgcagctgggactttggtcagctttgaccaaatttagagggagggatgtcatggggaaaaaaaacccaagcccaggagtctacccagccagcctgctccctagacagttaatttactatctggttattctctcaggtgcacagaattgagttgaccatactcctcagttcttggcacactatatcatcattggtccatgtgaggcccttttatttttttttcttcagttttgtccccttcatcacccattcctgatcccatcctccccgccccctacacaggcacccactctcgtgtatttaacgtacgtccttccaatccaccgttcatgtgtttatttacatatatgtgtatctgtgaaaaatgtatggtattgctgtgtgttttaatttacataaacagtattgtactataaa

SEQ ID NO: 2556 - DNA, 579 bp, Homo sapiens
ccagtgcacccctccggtgcctgctttccctgatgcctgcgatttagaccagcccggctgtatccacggcaacagaagcaggagtgtcactggccgccagatcactgagggtcccacaatgtggcccgggctgtgatttacctgggtgagacagcttgagccccatcgtggattccaagacatccctgctgagagagccaagatggagtttcgctcttgttgtccaggctggagtgcaatggcgcaatctcagctcaccacaacctccacctcccgggttcaagtgattctcctgcctcagcctccccagtagctgggattacaggtgcaatgtagcaggacaactcatggagcccccccgggcccatcgagtaccggactggctgaccccctagggttggcagtagcccctgaccctcagtatggccaacactaccggagagcctgaggaggtgagcggcgctctgtccccaccgtccgcatcagcttatgtgaagctggtactgctgggactgattatgtgcgtgagcctggcgggtaacgccatcttgtccctgctggtgctcaaggagcgtgccc

SEQ ID NO: 2557 - DNA, 1258 bp, Homo sapiens
caccattaggcaaagatagtttctctagagagaatcatgcctgctaattacacgtgtaccaggccagatggagacaatacagattttcgatactttatttatgcagtgacatacactgtcattcttgtgccaggtctcatagggaatatattagccctgtgggtattctatggttatatgaaagaaacaaaacgagctgtgatatttatgataaacttagccattgctgacttactacaagttctttccttgccactgaggatcttctactacttgaatcatgactggccatttgggcctggtctctgcatgttctgtttctacctgaagtatgtcaacatgtatgcaagcatctacttcttggtctgcatcagtgtgcgacgattttggtttctcatgtacccctttcgcttccatgactgcaaacagaaatatgacctgtacatcagcattgctggctggctgatcatctgccttgcctgtgtactctttccactcctcagaaccagtgatgatacctctggcaataggaccaaatgctttgtggatcttcctaccaggaatgtcaacctggcccagtccgttgttatgatgaccattggcgagttgattgggtttgtaactccgcttctgattgtcctatattgtacctggaagacggttttatcactgcaagataaatatcccatggcccaagatcttggagagaaacagaaagccttgaagatgattctaacctgtgcaggggtattcctaatttgctttgcaccttatcatttcagttttcctttagatttcctggtgaagtccaatgaaattaaaagctgcctagccagaagggtgattctaatatttcattctgtggcattgtgtcttgctagtctgaattcatgtcttgacccagtcatatactacttttccactaatgagttccgaagacggctttcaagacaagatttgcatgacagcatccaactccatgcaaaatcctttgtgagtaaccatacagcttccaccatgacacctgaattatgctaaaacaaaaaaccaaactgaatgtgacctgaaatgcaagtacatcagaacatatctgcaatacccaagccacagggaagaacttgcaaaacaacacagcttttcagttctgctctatcttactgctatggggaattcacttcttcaaagcaggacctatttggagcattacgatccacgattattgatgttgacatgtccatgtagtaatttttcttcaagt

SEQ ID NO: 2558 - DNA, 7980 bp, Homo sapiens
gtcctgagagctgccccaaggatgggcaccaggggagcggtcatgccccctcctatgtgggggctgctgggctgctgttttgtctgtgcctgggctctggggggtccacggcccatccgctctctgccccctctgtcttcccaagtcaagccaggatctgtacccatgcaggtgcccctagagggggccgaggccgccctcgcttatctctactctggagatgcccagcagctatcacaggtgaattgcagtgagcgctatgaagcgcgtggggcaggagccatgccagggctccccccaagcctacagggggcagcgggcacccttgcccaggccgccaattttctcaacatgctgctgcaagccaacgacatccgtgagtccagtgtggaggaggatgtggaatggtaccaggcactggtccgcagcgtggccgagggggacccaagagtgtacagggctttgctgacctttaaccctccaccaggggccagccacctacagctggccctgcaggccacccggactggggaggaaaccatcctgcaggacttgtctgggaactgggtgcaggaggagaaccctcctggggacctggacacccctgccctgaagaagcgagtgttgaccaatgacctagggagcctcggcagccccaagtggccgcaggcagatggatatgtgggggacacgcagcaggtgaggctgtctcctcctttcctggaatgccaggagggacggctccgacctggatggctgatcacactctctgccaccttctatggactcaagccagacctcagcccagaagtcagggggcaggtgcagatggacgtagatctccagagtgtggacatcaatcagtgtgcaagtggcccaggctggtactctaacacacacctgtgtgatctcaacagcacccagtgtgttcccctggagagtcagggctttgttcttggccgctacctctgccgctgccgacctggattctacggggcaagcccctctggggggttagaggagagtgacttccagactaccgggcaattcgggttcccagaaggcagatctgggagactgctgcagtgtctgccatgtcctgagggctgcaccagctgcatggatgccacaccgtgcctggtggaagaggccgcggtgctgcgggccgctgtgctggcctgccaggcctgctgcatgctggccatcttcctgagcatgctggtctcctaccgctgccgccggaacaagaggatctgggcatctggagtggtcctgctggaaactgtcctttttggattcctgctgctttactttcctgtcttcatcctatacttcaagcccagtgtattccgctgcatcgctcttcgctgggtgcggctgctgggttttgccatcgtctacggcaccatcatactcaagctttacagagtgctgcagctgtttctgtctcgaacggcccagcggagtgcccttctgagcagcgggcggctgctgcggcgcctggggctgctcctgctacctgtgctgggcttcctggctgtgtggaccgtgggcgccctggagcgaggcatccagcacgcacctctggtgatccgaggccacactcccagtggccgccatttctacctctgtcaccacgaccgctgggactacatcatggttgtggctgagctgctgctgctgtgctggggcagcttcctctgctacgccacacgggctgtgctctcggccttccatgagccacgctacatgggcatcgccctgcacaatgagctactgctttccgctgccttccacacagccaggtttgtgctggttccctctctgcacccggactggaccctcctcctcttcttcttccacacccacagcacagtcaccaccacgctggctctgatcttcatccctaagttctggaagctgggggctcctccccgggaggagatggtggatgaggtgtgtgaggacgagctggacctgcagcactcaggctcctaccttggcagcagcatcgcctcagcctggagtgagcacagcctggaccctggagacattcgggacgagctgaagaagctctatgcccagctagaggtccacaaaaccaaggaaatggccgcaaacaacccccacctgcccaagaagcgaggcagctcatgccagggactgggccgctccttcatgaggtacctggcggaattccccgaggccctggccaggcagcactcccgggactcaggatccccaggccacggcagcctgcccggctcctcccgccgccggctcctcagctccagcctccaggaacccgaggggacaccagctctgcacaagtcccgcagcacctatgaccagcgcagggagcaggacccgcctcttcttgactcactgctgaggaggaagctggccaagaaggcctctcgaacagagagccgggagtcggtggaggggccccctgccctgggcttcaggtcagccagcgcccacaacctgacggtgggagagaggctacccagagcccggcccgcctctctgcagaagtcgctcagtgtggccagctccagggaaaaggccttgctcatggccagccaggcctacctggaggagacctaccggcaagcaaaggagcgggaggagcggaagaaggccaaggcagccatggccagcctggtgcggaggccatcagccaggaggctggagcggcctcgaggggcccccctgtcagctccaccttcccctgccaagagcagcagcgtggacagctctcacacctctgggaggcttcatgaggaggctaggagaaggctgcctcatccacccatcaggcaccaggtttctacccccatcttggccctgtctgggggcctgggagagccaaggatgctatctcccacctccaccttggctccagctctgctgccagctctagctccaaccccagcccctgccctggcaccagtcccagtatccccacaaagccccaacttactcacctacatctgcccctgggagaacgcagaactgccagccaagcaagaaaatgtgccccaggaaggcccctcagggccagagcgaggccaccactcccctgccccagctcgagccaggctctggagggccctctctgttgcagtagagaaaagcagggctggggagaatgagatggacgcagaggatgcacatcaccagagggaagctaatgatgtggacgaagacaggcccaagatcttccctaaatcccacagcctcaaggcccctgttcagcagggttccatgcgcagcctggggctggcgattaaagctctgacccgttctcggagcacctacagagagaaggagagtgtggaggagagtcccgaggggcagaacagcgggactgcgggagagagtatgggggcaccctcccgatcgcccaggctaggccggcccaaggcggtgagtaagcaggccgctcttatcccctccgatgacaaggagtccctccagaaccaacagaacgctcacaccagcaggatgctccaagtctgtcaacgggagggcagcagggaacaagaagacagaggcaggaggatgacccagggtctaggggaacggaaagctgagagagcaggtaaaacagggcttgccatgctgaggcaagtttccagggacaaaaacatcaagcaatcaaaagaaacccctgtcgggtggcaggaactgcccaaagctggcctccagtccctcggcagcgctgaccacagggtggcagaggtatgcccctgggaggtcactgaatcagaaacgcgtcagccagacagtggcaacaaggccgaaatctgcccctgggagacgagtgaaggagccccagagtcgagggcactaagacaagacccaggtgactcccaaaaaaagagaggggaggcccggggaaaatcagagcccatagatgtggttcccatgatgcggaaaaagccagagaggctggtgagggagcaggaagcagtgtgtccctgggagagtgccgatcgaggaggtctgtcccctgggtcagctcctcaggaccctggcagaatcagagacaaatctgaggcgggggacagtgtggaggccaggaaggtggagaagcctgggtgggaagctgctggcccagaagctcatacccctgacatcaccaaggcagagccgtgtccctgggaggcaagtgaaggaggcgaggatgggaaaccagcccaagaggcagtgaaggatctccctcaggaaaagcagaaaaccaggaaagcaaccttttggaaagaacagaaaccgggaggagacttggagtctctttgtccatgggagagtacagatttccggggcccctcagcagtctcaattcaggccccaggaagctcagagtgttcagggagtttgggcagtggcattgctgaagtgtgtctgtgggaggcaggagatgctcctgctatccagaaagcagagatctgtccctgggagctggatgataacgtgatggggcaggaaatgctgagtctggggacaggtagagaatctcttcaagaaaaggaaaaagcctccagaaaaggaagctttggagagatgggggaacaaactgtgaaagcagtgcagaaattaagtcaacagcaggagtcagtttgtcccagggagagcacggtccctgggcactccagcccatgtctagacaattcctcatccaaagctggtagccaattcctatgcaatggaggaagcagagcaacgcaggtgtgtccacaggaagatctcaggccggaggcacaggaagcaacacctgccaaaacagaaatctgtccctgggaggtaaatgaaagaacaagagaggaatggacatcagcacaggtgccaagaggaggagaatctcaaaaggacaaggagaaaatgcctggaaaatcggaaatcgaagatgtcacagcttgggaaaagcctgaggggcagatccaaaagcaagaagcggtcggcccctgggagagtgtggaccctggcagcttctccccacaaccacgtcctcaagacacagagagaccccaaacccttctccagatgtcaggcagtgtgggaagcaaagctgccgacatttgccctttggatgtggaggaaaacttgactgctgggaaggcagaaatctgtccctgggaggtgggtgctggagcaggggaggaaagggctttgggagctgaggccattaggaaatctccaaatgatacaggcaaggtttctgcagatcttggacccagggagagagctgttactgctccagagaagccacagaagccaaccccagagtgggaggtggcttgtccctgggggagtgtgggtccaggggcctgttctcagcatccaggtactctagatgctgatggaccaaaagctgggttccaggaactggatcatatgggctgcaggccaggtgaagtgtgtccctgggaagcacaggaagctgctaccagtgaaaaagccaagatctgtccctgggaggtaagtgaaggaactactgggaagggattggaccaaaaggcagggagtgaatcagcagagcagagggagaaagctctagaaaaggggagactcacttccctgggagaagacgtatcaaaagggatggcaaaactgtgtcaacaacaggaaactatttgtatttgggagaacaaggacttgagggaatcccctgctcaggcccccaagatctcagacttgcccagcagcatgagtagtgaagtggcagagggacattccttggaagcaacagagaagggggacctgagacaagacccaaagacaggttccttcccagaacacataacccaagaaaaagctccagctgcagacacagaagaattcactactgaagatggggaaaaaacaagccatgagctacaatccgtctgtccatgggagaccactgccccagcagattccgtctctcacctagacagacagcgccctgaccaacctaaagctagctcccagagactggtcagcactgggggcagggccgctgacgtgtgcccatgggatgttcctgatgcaggtgtgtataaatctgacagcagtgccaaggctgagacctgtccctgggaagtgactgaaagaatccctgtcaaaggggtgtcaaggcaggatggaaaaggggactctcaagaagagaaaggcagagccccagaaaaatcagagccaaaaggtgtgccagttcagaaaaagccagagatggcagacttcaggcagcaggaggctgtgtgtccctgggagagtcaagatggcaagggtctgtccccacagccagccccagatgcttctgacagaagcagaggcagttctgaggcagcaggcagtgtggagaccagggtagcggaagtgtgtctgtgggaagtggtagaggctccctctgccaagaaagcagagatctgcccttgggaggcgggtggaggagcagcagaggaaggggaacaggaaagagaatcacaagggcaaggagagatgttccttcagaaggcaggacctggagggacggaagaacacttctcaaaagcagcagcaaagcccagagagcaggaggcagtctgccctggggaaggcacaggctcaggagggctcttgccccagtcaggtgccctggacccagaactcaaagtcagccccaaggaagcaggcagcatgggaagcaggatggcagagctgtgccaatgggaaatcacagatccagaaggaaataaaataaagggtaccatggcagacatctgtcctggggaggaaactggagtcccatctgaggaatctggcctcctggctttaacagcaactcggagagaatttttccccacagctcctgaaaaaccactatgccttttagtccatgggcctctggatcacttctttccagaaagcaaaatcccctgccccaaggtaagcaggccagccagtactttcactctagaaggtgtcagagaactacaaggaccttcagggcttgagccaaggaccagcttagccccagagccaagtctccaggaagctgagtctcagtcttcgtccttaactgaagactcaggccaagtggcttttgaagctcagtatgaagaattcacccctcccactgtctatccttgggattgggagtaacagccttattaggtgaggtcaaacacagagctagctttcaggagccaaggccctttccaagtccaggtgttcccaaagagctgaatcaaagacagcttggccacttcccctccttgagaagaccagaagtcaacccatcccaaagacaaactgcatgaaaagggtacagcttagaccccaatgggaaggcccaccctctctttacttctaacttttcttcctgtttgaggaaacaaagactggacactctacttctaaggacgcctcccatccacctacagtactcacaacacaaaccacccgagtctggacactcacccacaaagccactgttagggatgaaaaaagtcagttgtgcccagcctaccttctctcacagggggacccaattctctgaagtctacgatggagcattttttgagaagaaactaaaccatacaaagtgttggcaacgtagggatggtggaccacagaaggctataaaggccaccatagaaagctgaagagccatttaattgaagcggaagataaattgggggaaaagctaaaatgactcaaaataggggcctgaaaatgctttaaggaccttgtcattttgactttgaatctcctgtttctgctttattgcttctcatacctgccctgcttgactgctgaagcagaaacaatcaggcacgctgacacccttatcagcatctggcatccaaagcaacatcagagagagagaacacagaagaaaagcaattgccccaggtcctccccacagtcaagggagctcttccttccagacatccttgtgtgcctcttgctagttttttagggggtctccccctcttcctgccctagctctcacca

SEQ ID NO: 2559 - DNA, 1621 bp, Homo sapiens
cgtcggtgcagacctggagacgggcatgggggggctgcggctgctggctgtggccctcacgtgctgctggtggccgcagggcagccagggtaagaccctgcggggcagcttcagcagcaccgcggcccaggacgcccagggccagcgcatcggccacttcgagttccatggtgaccatgctcttctgtgtgtcagaatcaacaacatagcagtagctgttggaaaagaagctaaactctacctgttccaagcccaggaatggctaaagctacagcaaagcagtcatggttatagctgtagtgaaaaattatccaaagctcagttgacaatgaccatgaaccagaccgaacataatctgacagtgtcccagattccgtctccacaaacgtggcatgtgttttatgcagacaagtatacatgccaagatgacaaggagaattctcaggtggaagatatcccatttgaaatggtgttactaaacccagatgccgaagggaatccatttgatcattttagtgctggagaatctgggttacatgagttctttttcctcctagtcctagtgtactttgtgattgcttgcatttatgctcaatcattgtggcaggctattaagaaaggcggacccatgcacatgattttaaaggttctgacaactgcattgctgttacaagctggttcagctttagctaattacattcatttctccagttactccaaagatggaataggggtaccatttatgggaagtttggcagaattttttgacatcgcttcccaaattcagatgttatacttacttttgagtctatgcatgggttggacaatagtcagaatgaagaagtctcaaagcagacctctccagtgggattctacgcctgcatccactggcattgcagtattcattgtcatgacacagagtgttttgctactttgggaacagtttgaagatatcagtcatcatagctaccattcacaccacaacttagcagggatcctcctaattgttctaagaatttgcctagcattgtcattaggctgtggactctatcagatcatcacagtggagagaagtacactcaaaagggagttctacatcacatttgccaaaggctgtatcttgtggtttttatgccatccagttcttgcatgcatttctgtcatttttagcgactaccaaagagacaaggttattacaataggtgttatcctttgccagtctgtttccatggttattctctacagactctttctgtctcacagtctatactgggaagtttcttcactttcttcagtaacactaccactgaccatatcatctggacacaaaagtcgccctcatttctgatacttgatttttgttgagaggaaaagtgaattggttaaaagagtgcaataaggatccaaatacagtgacttttttttcatacatttagtatgaaaacttgaacagcgaaagcagagcatgttatttatataactgcatttaagcagtaccaagactgaaaaaaaaggtaataaatgaaatgttttgaaatatacttaaacaacaaactttgaagaaagtgttgttataaaattattgaagcgatttctatgtggaaataaatgtgaaaaataa

SEQ ID NO: 2560 - DNA, 1694 bp, Homo sapiens
gattgggggaatgcaggaaaaaccccatccctccctacagagcctcagcagtgacagctacttcccggatgagaagggcggccgtgaagccagcagggaagccagccccacagccaagggccccccagcctcctcacagctccccatagcctggacctgccggccctccctccaggaccgaggggctcccaagggaaactcaggcgtgtgctggtcccaatgtcagtgaaacccagctgggggcctggcccctcggagggggtcaccgcagtgcctaccagtgaccttggagagatccacaactggaccgagctgcttgacctcttcaaccacactttgtctgagtgccacgtggagctcagccagagcaccaagcgcgtggtcctctttgccctctacctggccatgtttgtggttgggctggtggagaacctcctggtgatatgcgtcaactggcgcggctcaggccgggcagggctgatgaacctctacatcctcaacatggccatcgcggacctgggcattgtcctgtctctgcccgtgtggatgctggaggtcacgctggactacacctggctctggggcagcttctcctgccgcttcactcactacttctactttgtcaacatgtatagcagcatcttcttcctggtgtgcctcagtgtcgaccgctatgtcaccctcaccagcgcctccccctcctggcagcgttaccagcaccgagtgcggcgggccatgtgtgcaggcatctgggtcctctcggccatcatcccgctgcctgaggtggtccacatccagctggtggagggccctgagcccatgtgcctcttcatggcaccttttgaaacgtacagcacctgggccctggcggtggccctgtccaccaccatcctgggcttcctgctgcccttccctctcatcacagtcttcaatgtgctgacagcctgccggctgcggcagccaggacaacccaagagccggcgccactgcctgctgctgtgcgcctacgtggccgtctttgtcatgtgctggctgccctatcatgtgaccctgctgctgctcacactgcatgggacccacatctccctccactgccacctggtccacctgctctacttcttctatgatgtcattgactgcttctccatgctgcactgtgtcatcaaccccatcctttacaactttctcagcccacacttccggggccggctcctgaatgctgtagtccattaccttcctaaggaccagaccaaggcgggcacatgcgcctcctcttcctcctgttccacccagcattccatcatcatcaccaagggtgatagccagcctgctgcagcagccccccaccctgagccaagcctgagctttcaggcacaccatttgcttccaaatacttcccccatctctcccactcagcctcttacacccagctgaggtagaggccagactcctccaacagtgaaggaaaaggcacaggtgagagtataggtgggagatttggggggatgtagaggggagggtcaaagcactcgtggtcaattttgaatctatcttaaaatactgaggtgtggagagagagacaggatcaggagcgatagagagcaggccctcagtgttgtactatttgtctcggtccttgtgtctaaggagcaatgcagaaaaaaaggtgaaataaatggaagagatagccatgg

SEQ ID NO: 2561 - DNA, 2508 bp, Homo sapiens
gactggaggcggatccagccggccagctgcctctctggagcccagctcttgggccccctgcactcacctgctcttcctgggctggctgtctcctgctcatccagccatgcggtggctgtggcccctggctgtctctcttgctgtgattttggctgtggggctaagcagggtctctgggggtgcccccctgcacctgggcaggcacagagccgagacccaggagcagcagagccgatccaagaggggcaccgaggatgaggaggccaagggcgtgcagcagtatgtgcctgaggagtgggcggagtacccccggcccattcaccctgctggcctgcagccaaccaagcccttggtggccaccagccctaaccccggcaaggatgggggcaccccagacagtgggcaggaactgaggggcaatctgacaggagcaccagggcagaggctacagatccagaaccccctgtatccggtgaccgagagctcctacagtgcctatgccatcatgcttctggcgctggtggtgtttgcggtgggcattgtgggcaacctgtcggtcatgtgcatcgtgtggcacagctactacctgaagagtgcctggaactccatccttgccagcctggccctctgggattttctggtcctctttttctgcctccctattgtcatcttcaacgagatcaccaagcagaggctactgggtgacgtttcttgtcgtgccgtgcccttcatggaggtctcctctctgggagtcacgactttcagcctctgtgccctgggcattgaccgcttccacgtggccaccagcaccctgcccaaggtgaggcccatcgagcggtgccaatccatcctggccaagttggctgtcatctgggtgggctccatgacgctggctgtgcctgagctcctgctgtggcagctggcacaggagcctgcccccaccatgggcaccctggactcatgcatcatgaaaccctcagccagcctgcccgagtccctgtattcactggtgatgacctaccagaacgcccgcatgtggtggtactttggctgctacttctgcctgcccatcctcttcacagtcacctgccagctggtgacatggcgggtgcgaggccctccagggaggaagtcagagtgcagggccagcaagcacgagcagtgtgagagccagctcaacagcaccgtggtgggcctgaccgtggtctacgccttctgcaccctcccagagaacgtctgcaacatcgtggtggcctacctctccaccgagctgacccgccagaccctggacctcctgggcctcatcaaccagttctccaccttcttcaagggcgccatcaccccagtgctgctcctttgcatctgcaggccgctgggccaggccttcctggactgctgctgctgctgctgctgtgaggagtgcggcggggcttcggaggcctctgctgccaatgggtcggacaacaagctcaagaccgaggtgtcctcttccatctacttccacaagcccagggagtcacccccactcctgcccctgggcacaccttgctgaggccccagtaggggtggggagggagggagaggccgccacccccgccggtgtctgctgttctttccccataggtcttgctttgttgcctgtcttgctgtctagggatggacttggttcctcttgtcaaggtttgggaatgtcaaagccccctccccacacagggcctttcctgtcccttgtggggccttccaaccctgtcctttccactggtgggcggtgatgcttctaggtccttagaactgcccagaaactctgagtcccagcagctgggagccagaactttgcctgccctcccttggttccagtctctcttctctctctctgccttggaacctgaccatactttagttgtgcccttcccaggcatcatcctcctaccaccaacctggggccccatcttggaatgggggctccttggggccagcccagtgtggctcaccacactcttctttttttttttttttttttttgagatggagtcttgctctgttgcccaggctggagtacatttgcctgatgtcagctccctgcaacctccgcctcctgggttcaagcgattctcctgcctcagcctcctgagtagctgggattacaggtgtgcaccaacacacccggctaatttttgtatttgtagaagaggcggggtttcaccatgttggccaggctggtgttgaactcctgacctcaagtgatctgcctgccttggcctcccaaagtgctgggattacaggtgtgagctgccacgcccagccccagtacactcttctctggaccagatctgtcccagtcctggatgcctcctcctactggtgccttcttttcttccagaggatttctctctccttcctcctcctttctttgggatccctgggttgccctgtcccaacctccttgttaggtgctttcccataggaggcccttcttgagaaacaataaactaggtagaactaccccta

SEQ ID NO: 2562 - DNA, 1886 bp, Homo sapiens
gatgccagacgcctgactggaggcggatccagccggccagctgcctctctggagcccagctcttgggccccctgcactcacctgctcttcctgggctggctgtctcctgctcatccagccatgcggtggctgtggcccctggctgtctctcttgctgtgattttggctgtggggcacagagccgagacccaggatgaggaggccaagggcgtgcagcagtatgtgcctgaggagtgggcggagtacccccggcccattcaccctgctggcctgcagccaaccaagcccttggtggccaccagccctaaccccggcaaggatgggggcaccccagacagtgggcaggaactgaggggcaatctgacaggagcaccagggcagaggctacagatccagaaccccctgtatccggtgaccgagagctcctacagtgcctatgccatcatgcttctggcgctggtggtgtttgcggtgggcattgtgggcaacctgtcggtcatgtgcatcgtgtggcacagctactacctgaagagtgcctggaactccatccttgccagcctggccctctgggattttctggtcctctttttctgcctccctattgtcatcttcaacgagatcaccaagcagaggctactgggtgacgtttcttgtcgtgccgtgcccttcatggaggtctcctctctgggagtcacgactttcagcctctgtgccctgggcattgaccgcttccacgtggccaccagcaccctgcccaaggtgaggcccatcgagcggtgccaatccatcctggccaagttggctgtcatctgggtgggctccatgacgctggctgtgcctgagctcctgctgtggcagctggcacaggagcctgcccccaccatgggcaccctggactcatgcatcatgaaaccctcagccagcctgcccgagtccctgtattcactggtgatgacctaccagaacgcccgcatgtggtggtactttggctgctacttctgcctgcccatcctcttcacagtcacctgccagctggtgacatggcgggtgcgaggccctccagggaggaagtcagagtgcagggccagcaagcacgagcagtgtgagagccagctcaacagcaccgtggtgggcctgaccgtggtctacgccttctgcaccctcccagagaacgtctgcaacatcgtggtggcctacctctccaccgagctgacccgccagaccctggacctcctgggcctcatcaaccagttctccaccttcttcaagggcgccatcaccccagtgctgctcctttgcatctgcaggccgctgggccaggccttcctggactgctgctgctgctgctgctgtgaggagtgcggcggggcttcggaggcctctgctgccaatgggtcggacaacaagctcaagaccgaggtgtcctcttccatctacttccacaagcccagggagtcacccccactcctgcccctgggcacaccttgctgaggccccagtaggggtggggagggagggagaggccgccacccccgccggtgtctgctgttctttccccataggtcttgctttgttgcctgtcttgctgtctagggatggacttggttcctcttgtcaaggtttgggaatgtcaaagccccctccccacacagggcctttcctgtcccttgtggggccttccaaccctgtcctttccactggtgggcggtgatgcttctaggtccttagaactgcccagaaactctgagtcccagcagctgggagccagaactttgcctgccctcccttggttccagtctctcttctctctctctgccttggaacctgaccatactttagttgtgcccttcccaggcatcatcctcctaccaccaacctggggcccc

SEQ ID NO: 2563 - DNA, 1233 bp, Homo sapiens
agacaccaggagcctgaatggggaacgattctgtcagctacgagtatggggattacagcgacctctcggaccgccctgtggactgcctggatggcgcctgcctggccatcgacccgctgcgcgtggccccgctcccactgtatgccgccatcttcctggtgggggtgccgggcaatgccatggtggcctgggtggctgggaaggtggcccgccggagggtgggtgccacctggttgctccacctggccgtggcggatttgctgtgctgtttgtctctgcccatcctggcagtgcccattgcccgtggaggccactggccgtatggtgcagtgggctgtcgggcgctgccctccatcatcctgctgaccatgtatgccagcgtcctgctcctggcagctctcagtgccgacctctgcttcctggctctcgggcctgcctggtggtctacggttcagcgggcgtgcggggtgcaggtggcctgtggggcagcctggacactggccttgctgctcaccgtgccctccgccatctaccgccggctgcaccaggagcacttcccagcccggctgcagtgtgtggtggactacggcggctcctccagcaccgagaatgcggtgactgccatccggtttctttttggcttcctggggcccctggtggccgtggccagctgccacagtgccctcctgtgctgggcagcccgacgctgccggccgctgggcacagccattgtggtggggttttttgtctgctgggcaccctaccacctgctggggctggtgctcactgtggcggccccgaactccgcactcctggccagggccctgcgggctgaacccctcatcgtgggccttgccctcgctcacagctgcctcaatcccatgctcttcctgtattttgggagggctcaactccgccggtcactgccagctgcctgtcactgggccctgagggagtcccagggccaggacgaaagtgtggacagcaagaaatccaccagccatgacctggtctcggagatggaggtgtaggctggagagacattgtgggtgtgtatcttcttatctcatttcacaagactggcttcaggcatagctggatccaggagctcaatgatgtcttcattttattccttccttcattcaacagatatccatcatgcacttgctatgtgcaaggcctttttaggcactagagatatagcagtgaccaaaacagacacaaatcctgccc

SEQ ID NO: 2564 - DNA, 1287 bp, Homo sapiens
cctgtgtgccacgtgctggacaaatcttaactcctcaaggactcccaaaaccagagacaccaggagcctgaatggggaacgattctgtcagctacgagtatggggattacagcgacctctcggaccgccctgtggactgcctggatggcgcctgcctggccatcgacccgctgcgcgtggccccgctcccactgtatgccgccatcttcctggtgggggtgccgggcaatgccatggtggcctgggtggctgggaaggtggcccgccggagggtgggtgccacctggttgctccacctggccgtggcggatttgctgtgctgtttgtctctgcccatcctggcagtgcccattgcccgtggaggccactggccgtatggtgcagtgggctgtcgggcgctgccctccatcatcctgctgaccatgtatgccagcgtcctgctcctggcagctctcagtgccgacctctgcttcctggctctcgggcctgcctggtggtctacggttcagcgggcgtgcggggtgcaggtggcctgtggggcagcctggacactggccttgctgctcaccgtgccctccgccatctaccgccggctgcaccaggagcacttcccagcccggctgcagtgtgtggtggactacggcggctcctccagcaccgagaatgcggtgactgccatccggtttctttttggcttcctggggcccctggtggccgtggccagctgccacagtgccctcctgtgctgggcagcccgacgctgccggccgctgggcacagccattgtggtggggttttttgtctgctgggcaccctaccacctgctggggctggtgctcactgtggcggccccgaactccgcactcctggccagggccctgcgggctgaacccctcatcgtgggccttgccctcgctcacagctgcctcaatcccatgctcttcctgtattttgggagggctcaactccgccggtcactgccagctgcctgtcactgggccctgagggagtcccagggccaggacgaaagtgtggacagcaagaaatccaccagccatgacctggtctcggagatggaggtgtaggctggagagacattgtgggtgtgtatcttcttatctcatttcacaagactggcttcaggcatagctggatccaggagctcaatgatgtcttcattttattccttccttcattcaacagatatccatcatgcacttgctatgtgcaaggcctttttaggcactagagatatagcagtgaccaaaacagacacaaatcctgccc

SEQ ID NO: 2565 - DNA, 3491 bp, Homo sapiens
gggttcaccacatcagccaccactcctgcttctgagcacagggtgctctcctcttgagctcagcttctgcttttgcagccaagcattcttgctgctgctgcctgcctgcccacccgcctgggcttgcagcccgccactttactttctccagccctgataccagctgagaagtctccctgcagctgctagttcctgcccaggaccatgtgtgtggatgctgcttgggagaagcgggcacttgctcctggcactgatcccagctgagtttctcctgttgatttctggaccactgatgctgttgctgaggaggtatttcccggcatccctccccctgagacaccggctaaggaccagcctaaacgcaaggcaggacagtgtcaggatggaccgcgctgccagaagccgacgctagcgagggaggtgtgaagagttggccagaatgaccaactcctcctccacatccacctcctccaccaccggtggctcgctgctgctgctctgcgaggaagaggagtcgtgggcgggccggcgcatcccggtgtcactcctgtattcgggcctggccatcgggggcacgctggccaacggcatggtcatctatctcgtgtcgtccttccgaaagctgcagaccaccagcaacgccttcatcgtgaacggctgcgccgccgacctcagcgtctgcgccctctggatgccgcaggaggcggtgctcgggctcctgcccaccggctctgcggagccccccgcagactgggacggcgctgggggcagctaccgcctgctacggggtgggctgctgggcctcggactcacggtgtccctcctctcccactgcctcgtggccctgaaccgctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggcccggcgccgcgccaccgcgagtccactacccggcgctgctggccgccgcggcgctgctggcgcagacagctctgctgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggcgtctcagcggcctgtcggtgctgctgctctgctgcgtcttcctgctggccacgcagccactggtgtgggtgagcctggccagcggcttctcgctgccggtgccctggggagtgcaggcggccagctggctcctgtgctgcgccctgtccgcgctcaatccgctgctctacacgtggaggaacgaggagttccgccgctccgtgcgctcagtcctgccgggcgtcggcgacgcggcggccgctgccgttgccgccacagccgtgcccgcagtgtcccaggcgcaactgggcacccgcgccgcgggccagcactggtaacctagccggggcccgagggaagcggagatccccggcttccgacgtccttgggcaccgtcgcctccttccctcctagggcatcccctgcctgaacgaagacttccgccgcgaagcccgatagatcgggggaaaatggggccttcgaccccagcgggctacctgaaccaaggcgtctctttaagtggggcgcccgaagtcattttggacggccacctgatttttaccctttgtttctgtgttttagaggaatcctaaagtcaaaacaccagagacttgaagaacttgcaaactggcgttttaaaataaccggttaatttatttccacacagtttgtttttgaaaaagagctttcataatgtataaccctttccactttcatcgtcttatatatgaagcgccttgagtgtgcatgaaccaaaggaaataacattgaagaaggaaaacaatatgtagaaagtattttagaaagtaacctgtctttgatgatgcttctcttaccatttagtttttgtatattaccctggggcagtgaagccctaggtgtgcccaccagtatgagttgccattaagacctcaagccctttattcttaaaagggtttttaataaagtctttctcaaatgaggtagaatcttagccagtgagaaaaaaaattattttatgctccttttttttcgcactcttaagactgaaaattggcgttgagtgttatagtgaaaattttccagtttgataattgatggtcagagccagcactggaattttgaaaacaaataaggtgattatctattttaggtaccgtttcacattttctatagcatgcacacttgttgctaccctcattttgtaaccaatttatttgccttatgaatgtgattgcagctttgaacattctgtactataatggttgctaagaagaataagtccttctgttttctctttaacatttaaaatatctcaatgcacatgatataattaaacactaataataccatgactgcatagctaatattagctgctattgcatgctcctagatgctagaacttattgggcatgtggtatactgaagcaatacccgttagacaaggatattttacttcttccagacaccagaagaaatggccttcaattatttgaaaagagacacagagacacctctggctacctagagttcttcctgtcttgacccaatttatgagaaagctcccagttgggactttatctcacaagtggaatcacagtcaagacggatcaataatatggtttggctcagcaaagccagctgtgctcttttagggtttaaacaagccacacgttagaaagcaacactgtttttatgtagttcatatatattaccatgacatttaacatcaatatcgtatatgttgaaggaggtataataaactcagtcatatatagtgaacagttcaaatgggaaagtgttctaaaacatattatttgagatttgtcatattcatctttggtttactaaatttacttagaaatatttgaaatgcaaaattgtgtgaaatcaccttatcaaattaaaatgggaagaaagtaattttaataatttttaataatcatatgtcagcattctgactacttaccacatcaaatctgggcccaaacagcctcagttaactgcataattcaggaacaaaaccagcttgctttgttgcacgcctgggcaatttcagccaggacattaggaccacttgttgtacatctgaataattatggaagttgggacatgttaaggaaaacaaatatgttcatcaccaacaatcagctgtcattttattaatctatcccttttgtgcatgcaccatttctctcttactaacagtttcatctgttcacattttccttgattcaaatattaaagttcagacaa

SEQ ID NO: 2566 - DNA, 1893 bp, Homo sapiens
atgtttttagggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccctcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagagatgtctatggtagctgagccaaacacgtaggatttccgttttaaggttcacatggaaaaggttatagctttgccttgagattgactcattaaaatcagagactgtaacacttttgccttacgttcattttatcaagcatagcttggtatttattatgcttgtgtgatctaacatgagttagcatcccacacctcctcttctgatcctgccccattaaaataaccaagaggttatctgttcttttccgggaaaggggtggtatgcacctgaaatagattttaccaaaagagagatttcagttatgtcattttttcttgatttcctgtgaacttagtattataccctactttcaattcggtagtgatgtttcctttttttttctatctgcccctcacgctgtggggtgaaaccgtgaataacttaactgggggaataagtcacttgtgaaagggaaatgttgaaaaatttttagaacactcagacatgcaatttaagaaaattctgaattttattactaaggtcttattctgtactttattgtgttttgggtttctagaggcaaatgaaggttaaagcataaaaagtgaatccaaaacaaaagcactatcaagcata

SEQ ID NO: 2567 - DNA, 1906 bp, Homo sapiens
agagtggtggggctgcagggtgggggcaggccagctcagcagagcctggggccagagggccagacagccacagagctcctggcgtgggcaaggctggccaaggatggcgacgcccaggggcctgggggccctgctcctgctcctcctgctcccgacctcaggtcaggaaaagcccaccgaagggccaagaaacacctgcctggggagcaacaacatgtacgacatcttcaacttgaatgacaaggctttgtgcttcaccaagtgcaggcagtcgggcagcgactcctgcaatgtggaaaacttgcagagatactggctaaactacgaggcccatctgatgaaggaaggtttgacgcagaaggtgaacacgcctttcctgaaggctttggtccagaacctcagcaccaacactgcagaagacttctatttctctctggagccctctcaggttccgaggcaggtgatgaaggacgaggacaagccccctgacagagtgcgacttcccaagagcctttttcgatccctgccaggcaacaggtctgtggtccgcttggccgtcaccattctggacattggtccagggactctcttcaagggcccccggctcggcctgggagatggcagcggcgtgttgaacaatcgcctggtgggtttgagtgtgggacaaatgcatgtcaccaagctggctgagcctctggagatcgtcttctctcaccagcgaccgccccctaacatgaccctcacctgtgtattctgggatgtgactaaagggaccactggagactggtcttctgagggctgctccacggaggtcagacctgaggggaccgtgtgctgctgtgaccacctgacctttttcgccctgctcctgagacccaccttggaccagtccacggtgcatatcctcacacgcatctcccaggcgggctgtggggtctccatgatcttcctggccttcaccattattctttatgcctttctgaggctttcccgggagaggttcaagtcagaagatgccccaaagatccacgtggccctgggtggcagcctgttcctcctgaatctggccttcttggtcaatgtggggagtggctcaaaggggtctgatgctgcctgctgggcccggggggctgtcttccactacttcctgctctgtgccttcacctggatgggccttgaagccttccacctctacctgctcgctgtcagggtcttcaacacctacttcgggcactacttcctgaagctgagcctggtgggctggggcctgcccgccctgatggtcatcggcactgggagtgccaacagctacggcctctacaccatccgtgatagggagaaccgcacctctctggagctatgctggttccgtgaagggacaaccatgtacgccctctatatcaccgtccacggctacttcctcatcaccttcctctttggcatggtggtcctggccctggtggtctggaagatcttcaccctgtcccgtgctacagcggtcaaggagcgggggaagaaccggaagaaggtgctcaccctgctgggcctctcgagcctggtgggtgtgacatgggggttggccatcttcaccccgttgggcctctccaccgtctacatctttgcacttttcaactccttgcaagggagctctgtggactgtcaagccctgtctgcaggtgagaagttactgtcactgttaggcctcccccaacagccctggaagctgcgggctgcagcccacctccccgtccggatgctgggtgctgacgttgactgcaaatggatgcgcttcgcttcccctcccagcccacaagcagttgaaagacaggaaggtgggccctcactttatgcaaggcgctgtgttcctggaagggaaattctggggcgtggacattgcatcatttga

SEQ ID NO: 2568 - DNA, 2670 bp, Homo sapiens
agagtggtggggctgcagggtgggggcaggccagctcagcagagcctggggccagagggccagacagccacagagctcctggcgtgggcaaggctggccaaggatggcgacgcccaggggcctgggggccctgctcctgctcctcctgctcccgacctcaggtcaggaaaagcccaccgaagggccaagaaacacctgcctggggagcaacaacatgtacgacatcttcaacttgaatgacaaggctttgtgcttcaccaagtgcaggcagtcgggcagcgactcctgcaatgtggaaaacttgcagagatactggctaaactacgaggcccatctgatgaaggaaggtttgacgcagaaggtgaacacgcctttcctgaaggctttggtccagaacctcagcaccaacactgcagaagacttctatttctctctggagccctctcaggttccgaggcaggtgatgaaggacgaggacaagccccctgacagagtgcgacttcccaagagcctttttcgatccctgccaggcaacaggtctgtggtccgcttggccgtcaccattctggacattggtccagggactctcttcaagggcccccggctcggcctgggagatggcagcggcgtgttgaacaatcgcctggtgggtttgagtgtgggacaaatgcatgtcaccaagctggctgagcctctggagatcgtcttctctcaccagcgaccgccccctaacatgaccctcacctgtgtattctgggatgtgactaaagggaccactggagactggtcttctgagggctgctccacggaggtcagacctgaggggaccgtgtgctgctgtgaccacctgacctttttcgccctgctcctgagacccaccttggaccagtccacggtgcatatcctcacacgcatctcccaggcgggctgtggggtctccatgatcttcctggccttcaccattattctttatgcctttctgaggctttcccgggagaggttcaagtcagaagatgccccaaagatccacgtggccctgggtggcagcctgttcctcctgaatctggccttcttggtcaatgtggggagtggctcaaaggggtctgatgctgcctgctgggcccggggggctgtcttccactacttcctgctctgtgccttcacctggatgggccttgaagccttccacctctacctgctcgctgtcagggtcttcaacacctacttcgggcactacttcctgaagctgagcctggtgggctggggcctgcccgccctgatggtcatcggcactgggagtgccaacagctacggcctctacaccatccgtgatagggagaaccgcacctctctggagctatgctggttccgtgaagggacaaccatgtacgccctctatatcaccgtccacggctacttcctcatcaccttcctctttggcatggtggtcctggccctggtggtctggaagatcttcaccctgtcccgtgctacagcggtcaaggagcgggggaagaaccggaagaaggtgctcaccctgctgggcctctcgagcctggtgggtgtgacatgggggttggccatcttcaccccgttgggcctctccaccgtctacatctttgcacttttcaactccttgcaaggtgtcttcatctgctgctggttcaccatcctttacctcccaagtcagagcaccacagtctcctcctctactgcaagattggaccaggcccactccgcatctcaagaataggaaggcacggccctgcaatatggactcagctctggctctctgtgtgaccttgggcagctccgtgcctctctctgtactccctcagtttccttctctgtacaatgtggctggggagggagaggatgggaccaggttggaccacgtggcatcagaggtcccatccagatccaactataggtccaagagtccacgtaagcaggtttgcaaggctctaaagttcctatagtcctgagaccccctgccagcaaagagtgacagtcacctccatgccctgccctcattgcaaagccctcactcaccttctggtctcagcaagggaggagagtctgttgctggcatagccctggaaggagcccccagcctctcccctcctcctccttgtcactggcctcccacaactccccttctggctgcctgtaaccttgaggggcattcaggaggccagcgttccctcaggcactgggggtttgttttggggggtgggagttgatcctcccacccagtctgcccctggtctctgcccatccaatcagagcccaccctcctggaagagacccccgtgttcagagtgctggcagccctgcacgtgtccagggacactgcatttcaaagaaccactgagtgggtgagctaccttgggcaaaccccccactcctgactctgactgccacgtgggtggcccgacctctgacctgctgtcatcgtagaggtagaaagcaaacaatctggggctcagcacacctgggggtgctcccactcattcagtgtgtggggcccctgagcagaggctgggcattgccactaggacctgagctcctagagaacaaggacctgggtggcctcgcttactgttccagcccaggccaagcacagggtctggctcgtggcaaaccttgaataaatatttgttggctgaa

SEQ ID NO: 2569 - DNA, 1785 bp, Homo sapiens
acagccacagagctcctggcgtgggcaaggctggccaaggatggcgacgcccaggggcctgggggccctgctcctgctcctcctgctcccgacctcaggtcaggaaaagcccaccgaagggccaagaaacacctgcctggggagcaacaacatgtacgacatcttcaacttgaatgacaaggctttgtgcttcaccaagtgcaggcagtcgggcagcgactcctgcaatgtggaaaacttgcagaggttccgaggcaggtgatgaaggacgaggacaagccccctgacagagtgcgacttcccaagagcctttttcgatccctgccaggcaacaggtctgtggtccgcttggccgtcaccattctggacattggtccagggactctcttcaagggcccccggctcggcctgggagatggcagcggcgtgttgaacaatcgcctggtgggtttgagtgtgggacaaatgcatgtcaccaagctggctgagcctctggagatcgtcttctctcaccagcgaccgccccctaacatgaccctcacctgtgtattctgggatgtgactaaagggaccactggagactggtcttctgagggctgctccacggaggtcagacctgaggggaccgtgtgctgctgtgaccacctgacctttttcgccctgctcctgagacccaccttggaccagtccacggtgcatatcctcacacgcatctcccaggcgggctgtggggtctccatgatcttcctggccttcaccattattctttatgcctttctgaggctttcccgggagaggttcaagtcagaagatgccccaaagatccacgtggccctgggtggcagcctgttcctcctgaatctggccttcttggtcaatgtggggagtggctcaaaggggtctgatgctgcctgctgggcccggggggctgtcttccactacttcctgctctgtgccttcacctggatgggccttgaagccttccacctctacctgctcgctgtcagggtcttcaacacctacttcgggcactacttcctgaagctgagcctggtgggctggggcctgcccgccctgatggtcatcggcactgggagtgccaacagctacggcctctacaccatccgtgatagggagaaccgcacctctctggagctatgctggttccgtgaagggacaaccatgtacgccctctatatcaccgtccacggctacttcctcatcaccttcctctttggcatggtggtcctggccctggtggtctggaagatcttcaccctgtcccgtgctacagcggtcaaggagcgggggaagaaccggaagaaggtgctcaccctgctgggcctctcgagcctggtgggtgtgacatgggggttggccatcttcaccccgttgggcctctccaccgtctacatctttgcacttttcaactccttgcaaggtgtcttcatctgctgctggttcaccatcctttacctcccaagtcagagcaccacagtctcctcctctactgcaagattggaccaggcccactccgcatctcaagaataggaaggcacggccctgcaatatggactcagctctggctctctgtgtgaccttgggcagctccgtgcctctctctgtactccctcagtttccttctctgtacaatgtggctggggagggagaggatgggaccaggttggaccacgtggcatcagaggtcccatccagatccaactataggtccaagagtccacgtaagcaggtttgcaaggctctaaagttcctatagtcctgaga

SEQ ID NO: 2570 - DNA, 7362 bp, Homo sapiens
aatttcatctggcgcccccgttcaatcagcctgcattgtcgaggctttaggagaggcagttaggaaaggagagatactgatctctcagccccagggcagcactaatggtgcctgtctagactctgacaggtggagctgctgagctaactacggacctggtgggggaagttttccttggctttcacgtggctttggctggggagccctgagaaggtggctgcctcctttttctgaagcctggcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtggctcccccgggaggtgacagctggcggggcccgtaaggagctggtctgctccggctcccctctcgtagccggcgccctgggaccagcgcgtgagcacgtctcggaggagtccgatgcgctgggcagggccgggtggtcacccccgcccagcttccaggggtgactgtgcctctgacgtcagacggtttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatcctttggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaatgagcattagactctgggggatagaacacgggctgccctgagagcttcatgttggagctgaagttcaaggttcacttcctttgggtttgtacttgacccttcttcatgtgtctctcccgttccctctaaaacaagtgtgtttcccctcatttttgaggctgtcaatggtgtgagagccaggatcatcacggggcctgaggttttactccagaaaagcagaggagtggcaaccttggcttggggtttggcagcccaggaaaggcagggaggagagctcaaagccggtttcatgtttcacccaaggtctaattgtgggagaggacaaatccagatcccctgtttgacagaattagttcacaaatgtctcttggcaaaaacatgtgacacctaaccatgataattgacttaatccaagaaagagctctgtagggcagagcaataggaaatctctctttcgttatggaaaaaaaataatccctctacatagaaactgagtgacatgtaaaaatgtgtagctaagtcagggagttacttcctaagagcctgacgctctgcttttcatcaaaaggaaaaaccagcgtgaggcagaggcgagggaggtggaggtgagtggatgatgtgctgagttagggatgtttatatgccgcaaaggtttggttggtaggcttcgcgctaagattagcctggctttgtactgaaaagggggaaggacacatagtgacacagatccttctggtctttcccaggaggtgtgacctaatgaggtttgttgtgagaataaagcaatgtggtttcacatatattatctatcataggctagggactcaagaaatgcatattccccccccactttctttctctctttccttccttccttcctttcttctttctttctttctttctttctttctttctttctttctttctttctctctctctctctctctctctttctttctttctttttgagatagagtctcactctgtcatccaggctggagtgcagtggcatgatctcagctcactgcagcctccgcatcctgggttcaagcgattttcgtgcctcggccttctgagtagctgggattacaggcgtgcgtgcgccaccacgcctggctaatttttgtatttttagtacagacgaggtttcaccatgttgaccaggctggtcttgaactcctgatcttaagtgatctgcccgccttggcctcccaaagtgctgggattacgggtgggaatcaccatgcccagcctcctttccatcttttctttccttctctggtcttcatactaccaaccaagcaagggaggaggagtaaaaggtaaaatcacaaaatactctggatcggcatttttttttttttttttttttgagacagggtctagctctatggcccaggctggagtgcagtggcacaatcatagctcactgcagcctcaactttctgtgctcgagtgattctcctgcctcagtctcctgagtagctgggaccacagacgtgcactaccacacttggctaattttattttttcagagatcacatgtggtttgagggaggatagagaggacagggtgtcaagaacagcatttttaccaagttgatataaaaatgaaacaggatccaggcatgggtctttacactgatagttacagtaagttttaaaatctgagcagcaatttgaatcacttgttgaaaaacacacaaaatatattttttgtagaggtgggggtcttgctctgttgcccaggctggtcttgaactcgagattctcctgctttggcctcccacaagtgctgggattacaggcgtgagctactgcacccggcctgctttctttttagtgaaaaggatctgtgggagcttttattcccatggctgccttcctcaagtcaacctctttccccggaaatggcatcatctctggactgttgtttctccttcttccttctcctccttctcctcctcctcctcctccaccatgcccggctgatttttgtatttttagtagagacagggtttcactatatgggccaggcagatctcgaactccaaacctcgtgatccacctaccttggcctctgaaagtgctgggataccgtggcctctgaaagtgctgggattacaggcatgagccaccgcgcccggccccgttgtttcccttctaagaaacgcagtggtctctgaagcctgcaggggcaggccagccctgcactgaacgcctgttcttgccaggtggcagaaggttgctgctcatttgagcagtacctgtcacccctcctcccactgctgcggctgttaactcatcttcaggtctcacaccttctgcacataaataagctatttttaaaagttattatttttttactctttcttttctttggagagggtaccaaaggatagctgttctgtttaagtagggacctctcatggcctacaggctttgacatctgagaatcaaactggagaacattccgaagccgttcttataagtgtctccatctctacctgggctgaaatggaatgtgcaaatgtagcccagcctggtccttgggtgttgccagttgattgatgactgggagccaaagtggcatctcctttgacctaaacgggcgatgatgaaataaaactcaacagcctttctctcatcttgcattgtgagatgcgaaatagagcgtgtctctctgcctctcattttaggctgaggccgtccaaagcggccatgccccatgtttccactagatggcgctgacacttcaggcatcaaccctcatggcctctcagccttgcaaaggcagccacttaaagtcggtgtcctgtgtggggcaccaagctgagctgcagacacccagtaggcgcgaggcaaatgcgtcccattttaagaggcttgtatttatgagctctttgcttcctccctcccactaactttaaagaattgctctccatctcctttggcaaagttcctttgccctttgtcttatttttgtgaaaccctccaaggtatttccagtccatttgcatccaatctggcatctttacggagagcggtctcatatgctattgttgttaacgtggactagtatttatgtgttgagaacactggctgtttgtcaggaaaagtgtgccaaaacaaagagtacggccggccctggaaatgcatcagcaaaacccatttcccccgtgcactcattctgagcttccttccttcatttctgtcattactgctgagaactggactgtgcccagctgacctttcccttccttgccctcatcttgctgccagggtctgcaggtttgccaccgtcccggccccagtctgaaacatgggattatttcagaattggaggtggcagcttcagaaaaaaatccttctcgtgtgttgactgctgagatccaggaactgggaaatcaacccccagtttgtagattgctctctttggaaattctgtggcccaacctcgtggctgttttctggaattccttctatcggggcagacagtgctgtgcctttcttgacttcaggatgttccaaggatgctgctggatctgtgtgtgtgtgtgtgtgtgtgtgtgtgtgtgtgtgtgtgcgtgcgtgcgtgtatgtgcgcctgaccctgatttctgcaacctccagatttctttcttgacccttcaaagtggaacagtccagtgccaaaaattttagagtttgagaaggtcacagaaatcctctagttggtgcctccacagtcttcattttacagaggaactcagggctaatggagttaatgcaactagatcagggttttgggtctgtgttctttctaccgtcagcacctgtgtggtcaattctggacacttcccagagaagtctttgagtagagaatcctactcaaatttcactgtatattttaagcattcctctcctttccctttgcctcccctgttgccttttcttcccctgatttctcctctggtcatctcctctcccttctgcgtgtaagccatgggaaagggatgagggaggacagcttctggttaaacacaggtccctcttccacatcaaatgaacattggcttcctgggacagaaggccttcaaaggagggattgcaaagcaaggcaaagcgttctgtcttcattttccccatccccatgagacaagactgatggaaagggtggtggggcaacactgcttaatggatgccttttcacatcatttcagtttttagccctcatgactgtattttctaatcagagacaataacattttaaataaaacaacgacaaagaa

SEQ ID NO: 2571 - DNA, 897 bp, Homo sapiens
gaggtgagcagctctgggatcactctgcaggaaaagaatagagggagaaagatctcagaggacccgaaggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccc

SEQ ID NO: 2572 - DNA, 2860 bp, Homo sapiens
actgagcaaatgagatagaaacatggcattcttaattatactaattacctgctttgtgattattcttgctacttcacagccttgccagacccctgatgactttgtggctgccacttctccgggacatatcataattggaggtttgtttgctattcatgaaaaaatgttgtcctcagaagactctcccagacgaccacaaatccaggagtgtgttggctttgaaatatcagtttttcttcaaactcttgccatgatacacagcattgagatgatcaacaattcaacactcttacctggagtcaaactggggtatgaaatctatgacacttgtacagaagtcacagtggcaatggcagccactctgaggtttctttctaaattcaactgctccagagaaactgtggagtttaagtgtgactattccagctacatgccaagagttaaggctgtcataggttctgggtactcagaaataactatggctgtctccaggatgttgaatttacagctcatgccacaggtgggttatgaatcaactgcagaaatcctgagtgacaaaattcgctttccttcatttttacggactgtgcccagtgacttccatcaaattaaagcaatggctcacctgattcagaaatctggttggaactggattggcatcataaccacagatgatgactatggacgattggctcttaacacttttataattcaggctgaagcaaataacgtgtgcatagccttcaaagaggttcttccagcctttctttcagataataccattgaagtcagaatcaatcggacactgaagaaaatcattttagaagcccaggttaatgtcattgtggtatttctgaggcaattccatgtttttgatctcttcaataaagccattgaaatgaatataaataagatgtggattgctagtgataattggtcaactgccaccaagattaccaccattcctaatgttaaaaagattggcaaagttgtagggtttgcctttagaagagggaatatatcctctttccattcctttcttcaaaatctgcacttgcttcccagtgacagtcacaaactcttacatgaatatgccatgcatttatctgcctgcgcatatgtcaaggacactgatttgagtcaatgcatattcaatcattctcaaaggactttggcctacaaggctaacaaggctatagaaaggaacttcgtcatgagaaatgacttcctctgggactatgctgagccaggactcattcatagtattcagcttgcagtgtttgcccttggttatgccattcgggatctgtgtcaagctcgtgactgtcagaaccccaacgcctttcaaccatgggagttacttggtgtgctaaaaaatgtgacattcactgatggatggaattcatttcattttgatgctcacggggatttaaatactggatatgatgttgtgctctggaaggagatcaatggacacatgactgtcactaagatggcagaatatgacctacagaatgatgtcttcatcatcccagatcaggaaacaaaaaatgagttcaggaatcttaagcaaattcaatctaaatgctccaaggaatgcagtcctgggcaaatgaagaaaactacaagaagtcaacacatctgttgctatgaatgtcagaactgtcctgaaaatcattacactaatcagacagatatgcctcactgccttttatgcaacaacaaaactcactgggcccctgttaggagcactatgtgctttgaaaaggaagtggaatatctcaactggaatgactccttggccatcctactcctgattctctccctactgggaatcatatttgttctggttgttggcataatatttacaagaaacctgaacacacctgttgtgaaatcatccgggggattaagagtctgctatgtgatccttctctgtcatttcctcaattttgccagcacgagctttttcattggagaaccacaagacttcacatgtaaaaccaggcagacaatgtttggagtgagctttactctttgcatctcctgcattttgacgaagtctctgaaaattttgctagccttcagctttgatcccaaattacagaaatttctgaagtgcctctatagaccgatccttattatcttcacttgcacgggcatccaggttgtcatttgcacactctggctaatctttgcagcacctactgtagaggtgaatgtctccttgcccagagtcatcatcctggagtgtgaggagggatccatacttgcatttggcaccatgctgggctacattgccatcctggccttcatttgcttcatatttgctttcaaaggcaaatatgagaattacaatgaagccaaattcattacatttggcatgctcatttacttcatagcttggatcacattcatccctatctatgctaccacatttggcaaatatgtaccagctgtggagattattgtcatattaatatctaactatggaatcctgtattgcacattcatccccaaatgctatgttattatttgtaagcaagagattaacacaaagtctgcctttctcaagatgatctacagttattcttcccatagtgtgagcagcattgccctgagtcctgcttcactggactccatgagcggcaatgtcacaatgaccaatcccagctctagtggcaagtctgcaacctggcagaaaagcaaagatcttcaggcacaagcatttgcacacatatgcagggaaaatgccacaagtgtatctaaaactttgcctcgaaaaagaatgtcaagtatatgaataagccttaggagatgccacattccagaataaaatgtttccagggtctttgcatct

SEQ ID NO: 2573 - DNA, 2622 bp, Homo sapiens
gaactgagcaaatgagatagaaacatggcattcttaattatactaattacctgctttgtgattattcttgctacttcacagccttgccagacccctgatgactttgtggctgccacttctccgggacatatcataattggaggtttgtttgctattcatgaaaaaatgttgtcctcagaagactctcccagacgaccacaaatccaggagtgtgttggctttgaaatatcagtttttcttcaaactcttgccatgatacacagcattgagatgatcaacaattcaacactcttacctggagtcaaactggggtatgaaatctatgacacttgtacagaagtcacagtggcaatggcagccactctgaggtttctttctaaattcaactgctccagagaaactgtggagtttaagtgtgactattccagctacatgccaagagttaaggctgtcataggttctgggtactcagaaataactatggctgtctccaggatgttgaatttacagctcatgccacaggtgggttatgaatcaactgcagaaatcctgagtgacaaaattcgctttccttcatttttacggactgtgcccagtgacttccatcaaattaaagcaatggctcacctgattcagaaatctggttggaactggattggcatcataaccacagatgatgactatggacgattggctcttaacacttttataattcaggctgaagcaaataacgtgtgcatagccttcaaagaggttcttccagcctttctttcagataataccattgaagtcagaatcaatcggacactgaagaaaatcattttagaagcccaggttaatgtcattgtggtatttctgaggcaattccatgtttttgatctcttcaataaagccattgaaatgaatataaataagatgtggattgctagtgataattggtcaactgccaccaagattaccaccattcctaatgttaaaaagattggcaaagttgtagggtttgcctttagaagagggaatatatcctctttccattcctttcttcaaaatctgcacttgcttcccagtgacagtcacaaactcttacatgaatatgccatgcatttatctgcctgcgcatatgtcaaggacactgatttgagtcaatgcatattcaatcattctcaaaggactttggcctacaaggctaacaaggctatagaaaggaacttcgtcatgagaaatgacttcctctgggactatgctgagccaggactcattcatagtattcagcttgcagtgtttgcccttggttatgccattcgggatctgtgtcaagctcgtgactgtcagaaccccaacgcctttcaaccatgggagcaaattcaatctaaatgctccaaggaatgcagtcctgggcaaatgaagaaaactacaagaagtcaacacatctgttgctatgaatgtcagaactgtcctgaaaatcattacactaatcagacagatatgcctcactgccttttatgcaacaacaaaactcactgggcccctgttaggagcactatgtgctttgaaaaggaagtggaatatctcaactggaatgactccttggccatcctactcctgattctctccctactgggaatcatatttgttctggttgttggcataatatttacaagaaacctgaacacacctgttgtgaaatcatccgggggattaagagtctgctatgtgatccttctctgtcatttcctcaattttgccagcacgagctttttcattggagaaccacaagacttcacatgtaaaaccaggcagacaatgtttggagtgagctttactctttgcatctcctgcattttgacgaagtctctgaaaattttgctagccttcagctttgatcccaaattacagaaatttctgaagtgcctctatagaccgatccttattatcttcacttgcacgggcatccaggttgtcatttgcacactctggctaatctttgcagcacctactgtagaggtgaatgtctccttgcccagagtcatcatcctggagtgtgaggagggatccatacttgcatttggcaccatgctgggctacattgccatcctggccttcatttgcttcatatttgctttcaaaggcaaatatgagaattacaatgaagccaaattcattacatttggcatgctcatttacttcatagcttggatcacattcatccctatctatgctaccacatttggcaaatatgtaccagctgtggagattattgtcatattaatatctaactatggaatcctgtattgcacattcatccccaaatgctatgttattatttgtaagcaagagattaacacaaagtctgcctttctcaagatgatctacagttattcttcccatagtgtgagcagcattgccctgagtcctgcttcactggactccatgagcggcaatgtcacaatgaccaatcccagctctagtggcaagtctgcaacctggcagaaaagcaaagatcttcaggcacaagcatttgcacacatatgcagggaaaatgccacaagtgtatctaaaactttgcctcgaaaaagaatgtcaagtatatgaataagccttaggagatgccacattccagaa

SEQ ID NO: 2574 - DNA, 2310 bp, Homo sapiens
gaactgagcaaatgagatagaaacatggcattcttaattatactaattacctgctttgtgattattcttgctacttcacagccttgccagacccctgatgactttgtggctgccacttctccgggacatatcataattggaggtttgtttgctattcatgaaaaaatgttgtcctcagaagactctcccagacgaccacaaatccaggagtgtgttggctttgaaatatcagtttttcttcaaactcttgccatgatacacagcattgagatgatcaacaattcaacactcttacctggagtcaaactggggtatgaaatctatgacacttgtacagaagtcacagtggcaatggcagccactctgaggtttctttctaaattcaactgctccagagaaactgtggagtttaagtgtgactattccagctacatgccaagagttaaggctgtcataggttctgggtactcagaaataactatggctgtctccaggatgttgaatttacagctcatgccacaggtgggttatgaatcaactgcagaaatcctgagtgacaaaattcgctttccttcatttttacggactgtgcccagtgacttccatcaaattaaagcaatggctcacctgattcagaaatctggttggaactggattggcatcataaccacagatgatgactatggacgattggctcttaacacttttataattcaggctgaagcaaataacgtgtgcatagccttcaaagaggttcttccagcctttctttcagataataccattgaagtcagaatcaatcggacactgaagaaaatcattttagaagcccagttacttggtgtgctaaaaaatgtgacattcactgatggatggaattcatttcattttgatgctcacggggatttaaatactggatatgatgttgtgctctggaaggagatcaatggacacatgactgtcactaagatggcagaatatgacctacagaatgatgtcttcatcatcccagatcaggaaacaaaaaatgagttcaggaatcttaagcaaattcaatctaaatgctccaaggaatgcagtcctgggcaaatgaagaaaactacaagaagtcaacacatctgttgctatgaatgtcagaactgtcctgaaaatcattacactaatcagacagatatgcctcactgccttttatgcaacaacaaaactcactgggcccctgttaggagcactatgtgctttgaaaaggaagtggaatatctcaactggaatgactccttggccatcctactcctgattctctccctactgggaatcatatttgttctggttgttggcataatatttacaagaaacctgaacacacctgttgtgaaatcatccgggggattaagagtctgctatgtgatccttctctgtcatttcctcaattttgccagcacgagctttttcattggagaaccacaagacttcacatgtaaaaccaggcagacaatgtttggagtgagctttactctttgcatctcctgcattttgacgaagtctctgaaaattttgctagccttcagctttgatcccaaattacagaaatttctgaagtgcctctatagaccgatccttattatcttcacttgcacgggcatccaggttgtcatttgcacactctggctaatctttgcagcacctactgtagaggtgaatgtctccttgcccagagtcatcatcctggagtgtgaggagggatccatacttgcatttggcaccatgctgggctacattgccatcctggccttcatttgcttcatatttgctttcaaaggcaaatatgagaattacaatgaagccaaattcattacatttggcatgctcatttacttcatagcttggatcacattcatccctatctatgctaccacatttggcaaatatgtaccagctgtggagattattgtcatattaatatctaactatggaatcctgtattgcacattcatccccaaatgctatgttattatttgtaagcaagagattaacacaaagtctgcctttctcaagatgatctacagttattcttcccatagtgtgagcagcattgccctgagtcctgcttcactggactccatgagcggcaatgtcacaatgaccaatcccagctctagtggcaagtctgcaacctggcagaaaagcaaagatcttcaggcacaagcatttgcacacatatgcagggaaaatgccacaagtgtatctaaaactttgcctcgaaaaagaatgtcaagtatatgaataagccttaggagatgccacattccagaa

SEQ ID NO: 2575 - DNA, 960 bp, Homo sapiens
ggctgctcctccatgttccgccaccagggtgccatttccctgatgatgagccaagagggacatgtgaggaggagggggccgggaccatctgccttgccgccccaccccttctctgtggccatacccaggggcttctcaaaacggtcacagcagcctcccttaaagctgggcatggggcgtatggtgacctacacctgcaagagcaagaaggcctggcggagaggtgaagtcagttctgcccatagcaagccaggaggtgttgggcaacctgcctgagaaggaggggaaggagccagcaggggacgcctctgggaaaacaggggcctcagacagcagccactttatccagatcctgcagttgaaggaagaatacctgcagagagccacagggccccgtgaggtcagccctgagccctccaccagggagaaggagtgtctgcttgaaggcctggaccaccccacttgctgccagcctgtcagtgaccaccacccattcacaggagactgcgtgttggcctcttccagggtggaggcaactccttggaaccacttccacagtttggacaaggagcttcaaaactcggccatggccaaggtttgcccagcgaggagaaaagtgaggaagagaaaatgaaggaagaggacagctcattcaagctctgtgtcccaggcattgttgccctccagtcgccaccgaacaaggctttcagatccacagacacagtgggtttcctggagtcggagttgaagaagcttctgggaatgcagcaagagtcccgcctctggaagctaggcagccaagagggccgagagctgcttacccggccagagatcaccgtggtggagggagaaggttatgaggtgcagagaagactgaggcatcttccttcacccatttctgtcgcccagtgcctgcttcttgaggagaaaggtgagatgggaaactggcctccagagtga

SEQ ID NO: 2576 - DNA, 4510 bp, Homo sapiens
cccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggtgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttccggcgtgcgcctggaggacttcaactacaacaaccagaccattaccgaccaaatctaccgggcaatgaactcctcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccatatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 2577 - DNA, 4299 bp, Homo sapiens
gcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggtgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttccggcgtgcgcctggaggacttcaactacaacaaccagaccattaccgaccaaatctaccgggcaatgaactcctcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccatatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 2578 - DNA, 3523 bp, Homo sapiens
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttccggcgtgcgcctggaggacttcaactacaacaaccagaccattaccgaccaaatctaccgggcaatgaactcctcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcactgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 2579 - DNA, 4070 bp, Homo sapiens
agtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttccggcgtgcgcctggaggacttcaactacaacaaccagaccattaccgaccaaatctaccgggcaatgaactcctcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccatatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 2580 - DNA, 4385 bp, Homo sapiens
ccctctcttccccccgccctgccttcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggtgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttccggcgtgcgcctggaggacttcaactacaacaaccagaccattaccgaccaaatctaccgggcaatgaactcctcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccatatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcggc

SEQ ID NO: 2581 - DNA, 2642 bp, Homo sapiens
agccacttccggcaggcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgccacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaa

SEQ ID NO: 2582 - DNA, 1911 bp, Homo sapiens
ttattctggacagttactcttaagaaagttgtcagaagaaacgcatctgcctttttttccaggtgaactgccgtgagttgtccagcatgatagtgtttattttcttggctatggggttaagcttggaaaatgaatacacttcccaaaccaataattgcacatatttaagagagcaatgcttacgtgatgcaaatggatgtaaacatgcttggagagtaatggaagatgcctgcaatgattcagatccaggtgacccctgcaagatgaggaattcatcatactgtaacctgagtatccagtacttagtggaaagcaatttccaatttaaagagtgtctttgcactgatgacttctattgtactgtgaacaaactgcttggaaaaaaatgtatcaataaatcagataacgtgaaagaggataaattcaaatggaatctaactacacgttcccatcatggattcaaagggatgtggtcctgtttggaagtggcagaggcatgtgtaggggatgtggtctgtaatgcacagttggcctcttaccttaaagcttgctcagcaaatggaaatccgtgtgatctgaaacagtgccaagcagccatacggttcttctatcaaaatataccttttaacattgcccagatgttggctttttgtgactgtgctcaatctgatataccttgtcagcagtccaaagaagctcttcacagcaagacatgtgcagtgaacatggttccaccccctacttgcctcagtgtaattcgcagctgccaaaatgatgaattatgcaggaggcactatagaacatttcagtcaaaatgctggcagcgtgtgactagaaagtgccatgaagatgagaattgcattagcaccttaagcaaacaggacctcacttgttcaggaagtgatgactgcaaagctgcttacatagatatccttgggacggtccttcaagtgcaatgtacctgtaggaccattacacaaagtgaggaatctttgtgtaagattttccagcacatgcttcatagaaaatcatgtttcaattatccaaccctgtctaatgtcaaaggcatggcattgtatacaagaaaacatgcaaacaaaatcactttaactggatttcattcccccttcaatggagaagtaatctatgctgccatgtgcatgacagtcacctgtggaatccttctgttggttatggtcaagcttagaacttccagaatatcaagtaaagcaagagatccttcatcgatccaaatacctggagaactctgattcattaggagtcatggacctataacaatcactcttttctctgcttttcttctttcctcttttcttctctcctctcctctcctctcttctcctctcctcccctcccctctctgtttctttttctttttcttttcttttttgtggcggagttttgctcttgttgcccaggctgcagtacaatggctcaatctcggttcactgcaacctctgcctccaaggttcaagtgattttcctgcctcagccttcccgagtagctgggattacaggtacccgccaccacgcccagctaatttttttgtatttttagtagagatggggttttgccaaattggccagggtggtctcaaactcctgacctcaggtgatccacccacctcggcctcccaaagtgctgggattacaggcgtgagcaaccacgtcaagacaacaatcactttctttaaagcaaatcctacagctggtcaacaccctattccatctgtcatcgagaaagaaaatgttaaaatagacttaaaaatattgctttgttacatataataatatggcatgatgatgttatttttttcttaatactcaagaaaaaatatatggtggtatcttttacaacactggaacagaaataaagtttcccttgaaggc

SEQ ID NO: 2583 - DNA, 2690 bp, Homo sapiens
ctgtaccttcccttcctcttccttcttttctcccttttttttcttttctttttttttttgacagggtctcactctgttgcccaagctggggtgcagtggcacgatcttggctcactgtagccttgacatcctgggctcaagggatcctcccatctcagcctcccaagtagctgcgactatgggtgtgacaccacgctgggctagtttttcaattttttgtagagatggagtctccctatgttgctcaggccggttgcaaactcctgggctcaagtgattctcctgcctcagcctcccaaagtgctgggattacagatgatagccacctcacccggcccacccctaccttctgaaagaggcattcttattcttattcccattttgcagatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctggtggggcagggagccttccgagcactccgggcagccctcgctgcctgcccctcctcccccttcccccctgcgatgccccgggtccttcggcacaggcacctggcccagtgtctgcaggagagggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcaccc

SEQ ID NO: 2584 - DNA, 2213 bp, Homo sapiens
ggatgtgtgctgagacccagagtcacccaggggtctccgtcacgtgccaggagtaggcagaagtgggctgtgacagatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcgcccccactgttccctcagaaggagcacagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctggtggggcagggagccttccgagcactccgggcagccctcgctgcctgcccctcctcccccttcccccctgcgatgccccgggtccttcggcacaggcacctggcccagtgtctgcaggagagggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcacccag

SEQ ID NO: 2585 - DNA, 2532 bp, Homo sapiens
cctggtggccggatttcccagttggggcccagccttttaaagccatcgctccttctttctggccggatgtgtgctgagacccagagtcacccaggggtctccgtcacgtgccaggagtaggcagaagtgggctgtgacagatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggagtggggaagaacagatagggcagaggacactagacttggcagctgcccattcaccggaagtatgtgtgcacatggggtctattcacagattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctggtggggcagggagccttccgagcactccgggcagccctcgctgcctgcccctcctcccccttcccccctgcgatgccccgggtccttcggcacaggcacctggcccagtgtctgcaggagagggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcaccc

SEQ ID NO: 2586 - DNA, 2573 bp, Homo sapiens
ctgtaccttcccttcctcttccttcttttctcccttttttttcttttctttttttttttgacagggtctcactctgttgcccaagctggggtgcagtggcacgatcttggctcactgtagccttgacatcctgggctcaagggatcctcccatctcagcctcccaagtagctgcgactatgggtgtgacaccacgctgggctagtttttcaattttttgtagagatggagtctccctatgttgctcaggccggttgcaaactcctgggctcaagtgattctcctgcctcagcctcccaaagtgctgggattacagatgatagccacctcacccggcccacccctaccttctgaaagaggcattcttattcttattcccattttgcagatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctctgaccaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctggtggggcagggagccttccgagcactccgggcagccctcgctgcctgcccctcctcccccttcccccctgcgatgccccgggtccttcggcacaggcacctggcccagtgtctgcaggagagggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcaccc

SEQ ID NO: 2587 - DNA, 1909 bp, Homo sapiens
ctgtaccttcccttcctcttccttcttttctcccttttttttcttttctttttttttttgacagggtctcactctgttgcccaagctggggtgcagtggcacgatcttggctcactgtagccttgacatcctgggctcaagggatcctcccatctcagcctcccaagtagctgcgactatgggtgtgacaccacgctgggctagtttttcaattttttgtagagatggagtctccctatgttgctcaggccggttgcaaactcctgggctcaagtgattctcctgcctcagcctcccaaagtgctgggattacagatgatagccacctcacccggcccacccctaccttctgaaagaggcattcttattcttattcccattttgcagatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggagtggggaagaacagatagggcagaggacactagacttggcagctgcccattcaccggaagtatgtgtgcacatggggtctattcacagattcctctgcgggctctgctccccactacgaggtgtttgtggcgctga

SEQ ID NO: 2588 - DNA, 2396 bp, Homo sapiens
ctccttctttctggccggatgtgtgctgagacccagagtcacccaggggtctccgtcacgtgccaggagtaggcagaagtgggctgtgacagatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctggtggggcagggagccttccgagcactccgggcagccctcgctgcctgcccctcctcccccttcccccctgcgatgccccgggtccttcggcacaggcacctggcccagtgtctgcaggagagggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcaccca

SEQ ID NO: 2589 - DNA, 1784 bp, Homo sapiens
ggcccggtctggagtttgcggagggccgagccgggtgcgcacggggaggcggaggcagcggcggcggcggcggcggcggcggcggcggcggagcagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgttgg

SEQ ID NO: 2590 - DNA, 1509 bp, Homo sapiens
gagccgggtgcgcacggggaggcggaggcagcggcggcggcggcggcggcggcggcggcggcggagcagcaggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctg

SEQ ID NO: 2591 - DNA, 1466 bp, Homo sapiens
ggcccggtctggagtttgcggagggccgagccgggtgcgcacggggaggcggaggcagcggcggcggcggcggcggcggcggcggcggcggagcaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgttgg

SEQ ID NO: 2592 - DNA, 1610 bp, Homo sapiens
ggcccggtctggagtttgcggagggccgagccgggtgcgcacggggaggcggaggcagcggcggcggcggcggcggcggcggcggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgttgg

SEQ ID NO: 2593 - DNA, 1928 bp, Homo sapiens
ggcccggtctggagtttgcggagggccgagccgggtgcgcacggggaggcggaggcagcggcggcggcggcggcggcggcggcggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgttgg

SEQ ID NO: 2594 - DNA, 1729 bp, Homo sapiens
ggtggaccatggaggccgcaaggcccttcgcccgggagtggagggcccagtccctacccctggcagtagggggcgttttgaagctgcggctctgtgagctgtggctactgctactgggttctagtttgaacgccagatttttgccagacgaggaggacgtagactttatcaacgagtacgtgaacctccacaatgagctgcggggcgacgtcattccccgagggtctaacttgcgcttcatgacttgggatgtagctttatcacggactgctagagcatggggaaaaaaatgtttgtttacgcataatatttatttacaagatgtacaaatggtccatcctaaattttatggtattggtgaaaatatgtgggtcggccctgaaaatgaatttactgcaagtattgctatcagaagttggcatgcagagaagaaaatgtacaattttgaaaatggcagttgctctggagactgttctaattatattcagcttgtttgggaccactcttacaaagttggttgtgctgttactccatgttcaaaaattggacatattatacatgcagcaattttcatatgcaactatgcgccaggaggaacactgacgagaagaccttatgaaccaggaatattttgtactcgatgtggcagacgtgacaaatgcacagattttctatgcagtaagataaagaaaataaacatgaaaaaaatgcataatggattggacaagaaaaataagcgattgaacactagttttttatggtcatgttaatattattcctttgatcagaatgctactattatgttatcaaaggatggttgacacagtatcatctttagatttttctaaactgcagagctttttctgttctatcttaaccctattccttcccctgaggacataccagagtgtcagaaagaaagaatgagaactaacagttatacccttaaaaagcttcacagtttatgcccaaacagcagcctgtttgataataactgctttaaaggatagtatattccaaaatatttatgaagtagcatatatttaatacccttttcttttagtttttcctccaaaaagctgaaatctccaaatatttcaaaagtaaaaagtagaaaatatgtttgattacatttttcttttagtttttccaaacatgagagaatatactccaaaagtataactgtagctaaaatatacaatgcttagaggaatatggtaggagataaatttggataataagtaaatagcatattatgttgttttttaattattatactttaagttctggggtacctgtgcagaacgtgcaggtttgttacataggtatatacatgccatggtggtttgctgcacccatgaacccatcatctacattagatatttctcctaagctattcctcccctagccctgaccccctgacaggccccagtgtgtgatgttcttctccctgtgtccatgtgttctcattgttcaactcccacttatgagtgagaacatgcagtgtttggttttctgttcttgtgatagtttgctgagaatgatggtttgcagcttcatccatgtccctgaaaaggaaatgaactcatccttttttatggctgcatagtattccatggtgtatatgtgccacactttctttatccagtctatcattgatgggcatttgggttggttccaagtatttgctattgtgaacagtgctgcaataaacatatgtttgcaggtg

SEQ ID NO: 2595 - DNA, 358 bp, Homo sapiens
agcgcgtgcgcactggcctgtcagcggccggtggaccatggaggccgcaaggcccttcgcccgggagtggagggcccagtccctacccctggcagtagggggcgttttgaagctgcggctctgtgagctgtggctactgctactgggttctagtttgaacgccagatttttgccagacgaggaggacgtagactttatcaacgagtacgtgaacctccacaatgagctgcggggcgacgtcattccccgagggtctaacttgcgcttcatgttatggtactgctgtgactccgatggtagcagattcatcattggatttccaaacctctcacccaggactccaagtgcacccctttga

SEQ ID NO: 2596 - DNA, 1903 bp, Homo sapiens
cagcggccggtggaccatggaggccgcaaggcccttcgcccgggagtggagggcccagtccctacccctggcagtagggggcgttttgaagctgcggctctgtgagctgtggctactgctactgggttctagtttgaacgccagatttttgccagacgaggaggacgtagactttatcaacgagtacgtgaacctccacaatgagctgcggggcgacgtcattccccgagggtctaacttgcgcttcatgttatggtactgctgtgactccgatggtagcagattcatcattggatttccaaacctctcacccaggactccaagtgcacccctttgaagactttgtcttcactcctgaatgattgattggggatccattgacttgggatgtagctttatcacggactgctagagcatggggaaaaaaatgtttgtttacgcataatatttatttacaagatgtacaaatggtccatcctaaattttatggtattggtgaaaatatgtgggtcggccctgaaaatgaatttactgcaagtattgctatcagaagttggcatgcagagaagaaaatgtacaattttgaaaatggcagttgctctggagactgttctaattatattcagcttgtttgggaccactcttacaaagttggttgtgctgttactccatgttcaaaaattggacatattatacatgcagcaattttcatatgcaactatgcgccaggaggaacactgacgagaagaccttatgaaccaggaatattttgtactcgatgtggcagacgtgacaaatgcacagattttctatgcagtaatgcagatcgtgaccaagccacatattaccgattttggtatccaaaatgggaaatgccccggccagttgtgtgtgatccactgtgcacattcattttattattgagaatattatgttttatcctgtgtgtcataactgttttgatagtacagtctcagtttccaaatatcttgttggaacaacaaatgatatttacccctgaggaatctgaagcagggaatgaagaggaggaaaaagaggaagagaagaaagagaaagaggaaatggaaatggaaataatggaaatggaggaggaaaaagaagagagagaggaggaggaggaggaaacacaaaaagaaaagatggaggaagaggaaaaataagagtagaaagaggaggaaaaagatgtatcaccaatataaaccaaaagtgtaatacaaaaaaagacagaaaaaaaaaaaaagtaaaacactgagttttaacaagaaagaaaatatgcaaaccaccattggaatgttttttattcccttctctcctatacttattcaatcaatttaaatttgtaaaacaaagaaacaaaaaacatgtaaggtgggctctttgacactaagaacagataaagacatgacaggaaaaacactgaaaaacatttgaccagtctaattaatcttaagatttcaccatgttattctaataaagtagggaattttcattttctaaacatgtttccatctctgtgttttaaatagtaaggtgcttaagatcattccaagttcataacaaccattgaataaaatttgtatttttttgtttttactgttactgtcatagtttttattggtggtagtggtattttcatgtgatattaaggtatctaatattattatttgtctttgtggtttttggaatagtttaagtggtacctgtacatcctgctaggatgcaaacttattatttataattaatgttcaatatttcattaaagacttgctgtaattttctgccaccaagggctaataaatgccataattttaattagttgtggtagaggaatctgggtgcttccaaatttatatgataaaataaataaattttttaaaaacta

SEQ ID NO: 2597 - DNA, 1618 bp, Homo sapiens
agcgcgtgcgcactggcctgtcagcggccggtggaccatggaggccgcaaggcccttcgcccgggagtggagggcccagtccctacccctggcagtagggggcgttttgaagctgcggctctgtgagctgtggctactgctactgggttctagtttgaacgccagatttttgccagacgaggaggacgtagactttatcaacgagtacgtgaacctccacaatgagctgcggggcgacgtcattccccgagggtctaacttgcgcttcatgacttgggatgtagctttatcacggactgctagagcatggggaaaaaaatgtttgtttacgcataatatttatttacaagatgtacaaatggtccatcctaaattttatggtattggtgaaaatatgtgggtcggccctgaaaatgaatttactgcaagtattgctatcagaagttggcatgcagagaagaaaatgtacaattttgaaaatggcagttgctctggagactgttctaattatattcagaggaacactgacgagaagaccttatgaaccaggaatattttgtactcgatgtggcagacgtgacaaatgcacagattttctatgcagtaatgcagatcgtgaccaagccacatattaccgattttggtatccaaaatgggaaatgccccggccagttgtgtgtgatccactgtgcacattcattttattattgagaatattatgttttatcctgtgtgtcataactgttttgatagtacagtctcagtttccaaatatcttgttggaacaacaaatgatatttacccctgaggaatctgaagcagggaatgaagaggaggaaaaagaggaagagaagaaagagaaagaggaaatggaaatggaaataatggaaatggaggaggaaaaagaagagagagaggaggaggaggaggaaacacaaaaagaaaagatggaggaagaggaaaaataagagtagaaagaggaggaaaaagatgtatcaccaatataaaccaaaagtgtaatacaaaaaaagacagaaaaaaaaaaaaagtaaaacactgagttttaacaagaaagaaaatatgcaaaccaccattggaatgttttttattcccttctctcctatacttattcaatcaatttaaatttgtaaaacaaagaaacaaaaaacatgtaaggtgggctctttgacactaagaacagataaagacatgacaggaaaaacactgaaaaacatttgaccagtctaattaatcttaagatttcaccatgttattctaataaagtagggaattttcattttctaaacatgtttccatctctgtgttttaaatagtaaggtgcttaagatcattccaagttcataacaaccattgaataaaatttgtatttttttgtttttactgttactgtcatagtttttattggtggtagtggtattttcatgtgatattaaggtatctaatattattatttgtctttgtggtttttggaatagtttaagtggtacctgtacatcctgctaggatgcaaacttattatttataattaatgttcaatatttcattaaagacttgctgtaattttctgccaccaagggctaataaatgccataatttt

SEQ ID NO: 2598 - DNA, 1554 bp, Homo sapiens
atgcttattaccatgatattacacagggccaggactaagacttgggatgtagctttatcacggactgctagagcatggggaaaaaaatgtttgtttacgcataatatttatttacaagatgtacaaatggtccatcctaaattttatggtattggtgaaaatatgtgggtcggccctgaaaatgaatttactgcaagtattgctatcagaagttggcatgcagagaagaaaatgtacaattttgaaaatggcagttgctctggagactgttctaattatattcagcttgtttgggaccactcttacaaagttggttgtgctgttactccatgttcaaaaattggacatattatacatgcagcaattttcatatgcaactatgcgccaggaggaacactgacgagaagaccttatgaaccaggaatattttgtactcgatgtggcagacgtgacaaatgcacagattttctatgcagtaatgcagatcgtgaccaagccacatattaccgattttggtatccaaaatgggaaatgccccggccagttgtgtgtgatccactgtgcacattcattttattattgagaatattatgttttatcctgtgtgtcataactgttttgatagtacagtctcagtttccaaatatcttgttggaacaacaaatgatatttacccctgaggaatctgaagcagggaatgaagaggaggaaaaagaggaagagaagaaagagaaagaggaaatggaaatggaaataatggaaatggaggaggaaaaagaagagagagaggaggaggaggaggaaacacaaaaagaaaagatggaggaagaggaaaaataagagtagaaagaggaggaaaaagatgtatcaccaatataaaccaaaagtgtaatacaaaaaaagacagaaaaaaaaaaaaagtaaaacactgagttttaacaagaaagaaaatatgcaaaccaccattggaatgttttttattcccttctctcctatacttattcaatcaatttaaatttgtaaaacaaagaaacaaaaaacatgtaaggtgggctctttgacactaagaacagataaagacatgacaggaaaaacactgaaaaacatttgaccagtctaattaatcttaagatttcaccatgttattctaataaagtagggaattttcattttctaaacatgtttccatctctgtgttttaaatagtaaggtgcttaagatcattccaagttcataacaaccattgaataaaatttgtatttttttgtttttactgttactgtcatagtttttattggtggtagtggtattttcatgtgatattaaggtatctaatattattatttgtctttgtggtttttggaatagtttaagtggtacctgtacatcctgctaggatgcaaacttattatttataattaatgttcaatatttcattaaagacttgctgtaattttctgccaccaagggctaataaatgccataattttaattagttgtggtagaggaatctgggtgcttccaaatttatatgataaaataaataaatttttt

SEQ ID NO: 2599 - DNA, 2609 bp, Homo sapiens
tgggacggccagcgcgtgcgcactggcctgtcagcggccggtggaccatggaggccgcaaggcccttcgcccgggagtggagggcccagtccctacccctggcagtagggggcgttttgaagctgcggctctgtgagctgtggctactgctactgggttctagtttgaacgccagatttttgccagacgaggaggacgtagactttatcaacgagtacgtgaacctccacaatgagctgcggggcgacgtcattccccgagggtctaacttgcgcttcatgacttgggatgtagctttatcacggactgctagagcatggggaaaaaaatgtttgtttacgcataatatttatttacaagatgtacaaatggtccatcctaaattttatggtattggtgaaaatatgtgggtcggccctgaaaatgaatttactgcaagtattgctatcagaagttggcatgcagagaagaaaatgtacaattttgaaaatggcagttgctctggagactgttctaattatattcagcttgtttgggaccactcttacaaagttggttgtgctgttactccatgttcaaaaattggacatattatacatgcagcaattttcatatgcaactatgcgccaggaggaacactgacgagaagaccttatgaaccaggaatattttgtactcgatgtggcagacgtgacaaatgcacagattttctatgcagtaatgcagatcgtgaccaagccacatattaccgattttggtatccaaaatgggaaatgccccggccagttgtgtgtgatccactgtgcacattcattttattattgagaatattatgttttatcctgtgtgtcataactgttttgatagtacagtctcagtttccaaatatcttgttggaacaacaaatgatatttacccctgaggaatctgaagcagggaatgaagaggaggaaaaagaggaagagaagaaagagaaagaggaaatggaaatggaaataatggaaatggaggaggaaaaagaagagagagaggaggaggaggaggaaacacaaaaagaaaagatggaggaagaggaaaaataagagtagaaagaggaggaaaaagatgtatcaccaatataaaccaaaagtgtaatacaaaaaaagacagaaaaaaaaaaaaagtaaaacactgagttttaacaagaaagaaaatatgcaaaccaccattggaatgttttttattcccttctctcctatacttattcaatcaatttaaatttgtaaaacaaagaaacaaaaaacatgtaaggtgggctctttgacactaagaacagataaagacatgacaggaaaaacactgaaaaacatttgaccagtctaattaatcttaagatttcaccatgttattctaataaagtagggaattttcattttctaaacatgtttccatctctgtgttttaaatagtaaggtgcttaagatcattccaagttcataacaaccattgaataaaatttgtatttttttgtttttactgttactgtcatagtttttattggtggtagtggtattttcatgtgatattaaggtatctaatattattatttgtctttgtggtttttggaatagtttaagtggtacctgtacatcctgctaggatgcaaacttattatttataattaatgttcaatatttcattaaagacttgctgtaattttctgccaccaagggctaataaatgccataattttaattagttgtggtagaggaatctgggtgcttccaaatttatatgataaaataaataaattttttaaaaactattaacttgttattcaataggtatagtaaaagttaacagattaataagataactgcttaccactagtaatactaataaatgaactaaataaaaatacctagcataggagatttctttatctataaaataaatggatagcactagatgaccactaagacctcttccatcaatgaatattcatggatcaactttgtaaaggaatcaatagtagttgtgaagtacactaagcaaacacctgagggaaaaacttgattcccatgaaaatattcctgaactcagcaccttatatggcaaaataataaataccttttattactcaattttaaaataggcaaaaagcaatgtataatatttttccaattgccattccatactcagctgtcttattgttgcacacttattagaactcaatgtgactgagatgtgaaaggttgatataattctatttatgacagggacttagggaacttattctaattgagaatcagaggcttaataaacctgaaggtttaagtgaaagaaatgacattgaaagaatcactgcatatctgatgttttcaaataaaacaatctctgttttctggttttgatagaatattgtgttctaaagctatatttctcaatgtgtggttccactgagggaaagaaaaaaaaaaaaacctagcatagccaaatacctcaaatggtataaatgctatgtgtatttactctgttgttctttagttgtatcaatattctgttaaaaacctgttcgaagtagggcaagatgagaattatattaaaaagccctgagctatcctcttgga

SEQ ID NO: 2600 - DNA, 3860 bp, Homo sapiens
gaggtggaggcgttggcgctgccacgtctgggccgcggttcccaactgtggcgcgggcggtggaggaggaggtggggctggcgctgaagccggatccggatccggtgctgtgcacactggtgggggagagtccgacgcgcctggctaggagcgccgaccgcagggcctctacggaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtaataaggagttatatgtctgctatctgtgttgctcatttaaaaaaagtatacattgaataaggctgtttatcacatgcataaaattaaatatttttgtttcaaagaaacatctcaatacacttaggggtgtattgtttcccacatattaagtcagggtggataaattagttattataactaaacatagtatagtccaacattcgttgatcccaatacaggcaaacaacctggtcaaccttttgaagtagaagaaatgaaaattacttgacaagattaaaagtaaaacaatttaaatgttttactgaaagtttatatagtatagtctatgtagataaaaagtaccacttgtcttttctgtgaattatgactattcatttgttaaaaatacctaagagcaattatagtgggacatctaaggtcctctgtaaacagtgaattagcaaacctcagcctatgtgtttctaccctgatttttttcttttcatgggtatctgaagcctctaagttttttcaaaaatggagtatcacaaaattgagtgaaacacaatacttaatgtattgtactagattgccaaattcataaaatgttaatggaagctttttgatgtgattataatggcactattctggtcattatcctattttgattttatttaattttttaaagttgaagaattaaatattttaatggttctaatcttttgcattccatgttgcattaaacctgtttatatgagtagtcttctgttagaatcacatctgtgcttttcttgagtctgctgttgaactattagattaagtcataattcataaaattttagtttaatgtgctctttgtaaaatgaaattgtaaagaaaataccagtgtttctcatcccattgactcacaccacgtcatctggattttggatttccctccatgcagccagctatagttggctttccaaaacaacagaaatccttcaccaatagagtgcactacttacctgcttatagcctatacagacgaactgatctgtccttcgtgaaacgcaacaaagctagttctgtcttttcagaagtcctacaaccttgacaaagagtagttttatcaggtaaatcctggtaattaaaaacgcatgtttttaaaaattagcctggtaaggccgggtgcagtggctcacgcctgtaatcccagcactttgggaggctgaggtgggcagatcacaaggtcaggagtttgagaccagcctgaccaaaatggtgaaaccctgtctctactaaaaaaaagaaaaattagccagacgtggtggcatgcgcctgtaatcccagctactcaggaagctgaggcgagagaatcgcttgaacccgggaggcaaaggttgcagtgagctgagatcacaccactgcactccagcctggcgacagagagagactccatctcaaaacaaaacaaaaaaaattagcctacttaaaggcacaactaaatgctttattacctttcttaccactgaacaatttgaggtaaaatcattcacaaggttggcacttcagtaaatccctttaaatagtgttcctaagatatctcttaaatcctcccataggaaatagaattacaggtaaggtacaccatacaaaaattgtgtcattgaggacaatggtgatctgtaattttagttgagtatgtttatgatttttgaagccatatggtgagtaaatgtaaatatgaaaaaagtgctacataaaacacttcttaaactttttttttttaaaaactgctccttgtggagcaggactaccccataggcagtgtacccacaatagatagccttttgttgttgttgttgttgagacaaggtctcgctgttgcccaggctagagcgcaggggcacaatcaccacacactgccgcttcaatctcctgggctcaaatgatccttccacctcagcctcccatgtggctgggactataggtgcatgccaccacacccagctaattaaaaaaattttttgtgtggagtctatgttgcccaggctggtctcttaactcctaggctcaagtgatcctcccacctcagcctcccaaagtgcttggatgacaggtgcgagccactgcacctggcccacattttttaaagagacactgtcccactccatcacccaggctggagtccagtggtgtgatcatagctcactgcatcctccagttcctgggttcaagccatccctcctgcctcagcctccccagtagctggaactacaggtgtgtgccatcacacctggctttacatttttctgtggggtcttactatattgcccaagccggtctcaaactcctgagctcaagtgatcctctgcctcagcctccagagtatctgggattacatatgtcggctaccgtgtctggccgttcacatctttggccactatttgcttgtgaaaaggtataatgaggtggtacttatcatttttactgtgtctcatgttttgtatatttttgtttcatcaactaagatgcactgtaacatctctgaaatctggatatattatcaatggtttatcatagttttgttagcaatacactgtcttttagtggtgcctaaaataatggtatagttgtgaggtgatcttagatttgatgaagcacagtatgcaggtaggcctaatgggggaagatggtaatataaaagcaagaagtattttttttttgtaatgactgaaagctgttctgtggatgacctaccctttcctttaaacacgattctctcacttccaactccaaacttgctcaactaatccttaaaaataaacttgagctggaatttg

SEQ ID NO: 2601 - DNA, 785 bp, Homo sapiens
gggcgggtggcgccttggcctccgcctccgctcgcctgcgcgcggccctgcgtgagggggcagaggcgaggtggaggcgttggcgctgccacgtctgggccgcggttcccaactgtggcgcgggcggtggaggaggaggtggggctggcgctgaagccggatccggatccggtgctgtgcacactggtgggggagagtccgacgcgcctggctaggagcgccgaccgcagggcctctacggttcctgtaaccagcacagtgcctgattcatgaattaaagaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggttt

SEQ ID NO: 2602 - DNA, 3436 bp, Homo sapiens
tcaatgcactgttcaaggatgtttgagagattttctgtcttgcctgaatacaaaacactgtagggaacctctttgtgcttgactttgcacacacacgggatcttcagggtgggtacatttaaaactgacaagtattgccaaattgccccccaacgtagtttttacaccccacctactactctcagtgaaaaatcaggccctttttattttaagggctaaattgctaatccctgtgtgaaaatgggtgttaacaaaataaaaaataaggaaaatatgcaggcttacccaattttgttatctatacattttacagtctctaatacttagcatagctcctttgggtgtctgcccaccacccttctttctgaacgtggggttccctgggctttccttgtttgacttcagacctggatctaatagggatctggaggtagaatcaagacgaatgttccctttggccttaggtgagtcctttgcatctctgaggccctgttgatgacatccagttctctagacctctgcccaaaccagagcaatccctcctcaaatatgctaagcagaaatgcagacaatataagacacactatatttatattttaggagtttacattaccttcccttctgtttggaaaccaacatctctcaaaattaggtatagttaacacagaataccccaaaataccaccattcttcataattccatttccttatttctggattctttcaagggtaaaaaccttgtttcattcatctttggggcagcatttgcctagtatgtggtaggcgcccagtagattttggataaactgacctgattttctgttaatattccaactggattatttctttctcctcttacagaatgaagatattcaaatgttattttaaacataccctacagcagaaagttttcatcctgtttttaaccctatggctgctctctttgttaaagcttctaaatgtgagacgactctttccgcaaaaagacatttacttggttgagtactccctaagtacctcgccttttgtaagaaacagatacactcatgttaaggatgaagtcaggtatgaagttaactgttcgggtatctatgaacaggagcctttggaaattggaaagagtctggaaataagaagaagggacatcattgacttggaggatgatgatgttgtggcaatgaccagtgattgtgacatttatcagactctaagaggttatgctcaaaagcttgtctcaaaggaggagaaaagcttcccaatagcctattctttggttgtccacaaagatgcaattatggttgaaaggcttatccatgctatatacaaccagcacaatatttactgcatccattatgatcgtaaggcacctgataccttcaaagttgccatgaacaatttagctaagtgcttctccaatattttcattgcttccaaattagaggctgtggaatatgcccacatttccagactccaggctgatttaaattgcttgtcggaccttctgaagtcttcaatccagtggaaatatgttatcaacttgtgtgggcaagattttcccctgaagtcaaattttgaattggtgtcagagttgaaaaaactcaatggagcaaatatgttggagacggtgaaacccccaaacagtaaattggaaagattcacttaccatcatgaacttagacgggtgccttatgaatatgtgaagctaccaataaggacaaacatctccaaggaagcacccccccataacattcagatatttgttggcagtgcttattttgttttaagtcaagcatttgttaaatatattttcaacaactccatcgttcaagacttttttgcctggtctaaagacacatactctcctgatgagcacttttgggctaccttgattcgggttccaggaatacctggggagatttccagatcagcccaggatgtgtctgatctgcagagtaagactcgccttgtcaagtggaattactatgaaggctttttctatcccagttgtactggatctcaccttcgaagcgtgtgtatttatggagctgcagaattaaggtggcttatcaaagatggacattggtttgctaataaatttgattctaaggtggaccctatcttgattaaatgcttggcagaaaagcttgaagaacagcagagagactggatcactttgccctcagaaaagttatttatggatagaaatctcactaccacatcatgatagtaaaatcaggatggaaataagagggtgcctgataaatggagtcagtgtggaattgaataccatactatgcccaatactgtttaaactcagtcctcccatattttaaaaggtgtccaaaattccatacacaagggaaagtgatctagcctttgatgttattagcctgcagttggctaggtttttttaatatttgtttttgcttgtaatctcactgagccaaatcagagatcttaaacattcagtcagtcatcaaacattattgagcacctaactatatgacaggcacttttttagagactgcggcttatcctcatcatagcaacctcggtatctttaagttctccacataacagtcaggattctactgaagaagcttttgaagtttgtggtaatcgtctgatcatataaaccacccatttcagagtagtgtttaagtactgtgaccaacactccacttgtctcttaactcagctttcaagacatttcttaaccatcagagcagaggaggaaagactcactacctcagaaaaatctcaaagaatagtccaatttcctgcttgccaaagcataatctgccttttggtgcattacttggtcaattcagggttgaggagactgttggggggcatttataatgtatgaaagttaaggaagggggtgaggatgtgggttgggacaggtagtacctaaagaggagcgaagggatttatacaacatttttatcatgttacaaaacagtatcatgaatggcctcctttttagttcaactgtttctttaaaatgcatttactgattaaaaataagaactgaccaatagctccaagtgtcacacaccagaacattaagcctaagtcctcaattcataagttatcattctagataagtttctttacaatggaatactttctgtggaatcattataattctgttgtatggaactatcaagctaagagtcactaaactttcttcaaaaggttgtgtgaaatatgacagctttctaaattaatttgtatagtcatttaaaattttttcttctctggcaactgtccaactggaatccagatttaaagtgataaaagctctaagtttcttgcagtctttttctcagcttagttccagagagaaaaaagctaattttcctaaggacacagcaagaatattcattaaggatattttctaaaacccacacttgagaaaaccacccaatga

SEQ ID NO: 2603 - DNA, 2064 bp, Homo sapiens
ataagctccacctcgagttccattaaggtattgaatgcacagtctttgttgggggaagcatttctttttttctttaatggagagtgaagttggccgcctcgaaggccaggaggactctgctcctgtcaggaaagatactcaagctatcatctgtaaacatgaacaacatttactgctggatggggaatcaccagcgcatggaagaactcttggtggatgcgttgtctggagcctgctcactccgccacgttactcagcaatgctttccctgtttctggataccacgctcccttctgaacgatgaagcatgaagcaccacgctccataaaagaccctccctctccccgtgggagggctcaggaagctatgagacctgagtatgtactgccttaaatcaacagcaacagaaggatctggtcccaaggaaatactcagagaagcaaaagcagcaacttttcaatctgcaggtcagaaccaacaggaataaaactctccagggacagatggcaacaaaacctgccaagcaactctactcaagtgactgaagcaggcgccgctgccggggaggaaccgatgggagagaaaggccaggctgggccctgacaccgccaggactccccctccaggaaccagggggcttctcctggaagcttaaaggaaaaaatacttaaattatggtaataagaatgcacctggagctcaagatatgagccagcttcgagccacaaagtctggacttgtcgtgagggcagtcatttgcatcttcatttttctttacttaaggaatccaactcctgcagaatcagaagaagaacctgcccaaccagaagtagtagaatgtggcttttacccagatgaactgtgttccgctttatttgaagggaaaggggcggccccctaaattgcaaaattttgcaaaacccctcataaatctgaaatacatgctcatttacacacaccaggaaactgctccaggatttctcgggggctgcatttcataaccagacccctgtctgcagaagagggcgatttctctttggcatatattataactattcataaggagctggccatgtttgtgcagcttctcagagctatttatgtacctcaaaatgtttattgtattcatgttgatgaaaaggccccaatgaagtataagactgctgtgcaaaccttggttaactgttttgaaaacgtttttatttcctccaagacagagaaggtggcttatgctggctttacaagactacaggcagatattaattgtatgaaagttctagtgcattctaaatttcaatggaactatgtcatcaatctttgtggacaggattttcccatcaaaaccaacagagaaatcatacactacatcagaagcaaatggagtgataaaaatattactcctggagtaatccaaccattgcacattaaatccaagacaagtcaaagtcatctcgaattcgttcctaaaggaagtatctatgcacctccaaataacagattcaaagacaaaccaccccataacttaaccatttattttggaagtgcttactatgtacttacaaggaagtttgtagagttcatactgactgacatccatgcaaaagacatgcttcagtggtccaaagacatccgcagcccagagcaacactactgggtgaccctgaaccgactaaaagatgctccaggtgctacaccaaacgctggctgggaaggaaatgttcgagccattaagcggaaaagtgaggaaggaaatgttcatgatggatgtaaaggccgctacgtcgaagacatctgcgtatacggaccaggagacctgccgtggctcattcagtcgccttctctgtttgccaacaaattcgaaccctcgacagacccgcttgtggttacctgcttagagcggcggcacagacttcaagtgctgaggcaggcagaagttcctatagagccacactggcattttcaacagcagagtcatttcaatatgagactgaaccgctagggagtgtttgctttcttactggtatcattctgtttccttgacttgaaacaagagaacattgaacc

SEQ ID NO: 2604 - DNA, 1672 bp, Homo sapiens
taggctgtgatggaatctgaaatgaagtttgacaaggaccatgatggactcattgaaaatggaggctatgcagaccagacctatgatggatgggtgaccacaggccccaggttagcgggtaggggtttccaggaggcctgaggtgagaaactgggcaacaagggattgtagggctcaagaaagaatgactcattgtctattacacggcatgggagcagctggagctgccagtctgacccccaaacccatgtccctgatcagtgcttactgtggagggctgtggctggcagctgtggctgtgatggtccagatggctgctctgtgtggggcacaggacatccaggataagttttcttctatcctcagccggggccaagaagcctatgagagactgctgtggaatggtgagttcggggagcctaagtagtcttaaggcagctgagaggacaccaggagccttatttttctcttcctcgactccaggccgctattacaactatgacagcagctctcggcctcagtctcgtagtgttatgtctgaccagtgtgctggacagtggttcctgaaggcctgtggcctaggagaaggagacactgaggtgtttcctacccaacatgtggtccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagaggtaatgcactccttttcccatctctccaccatctgtatcctggcccagaaaacttcctcaaccaccaaatttcttcaaggcataacccaatgccatcttgtccgtctataaagcctcccatttttccctggtatgcattccagctcctgccttcaggcttctgtctgtgggtcatagttatctcctccacttgctgggagctccttgaaggcaaagactctactgcctccatctatccagtggaagtggctcttcagagggtgccaagttagtatgtatgactgtcatctctcccaacagggcctgacttgggagggcttccagacagctgaaggctgctaccgtaccgtgtgggagcgcctgggtctggccttccagaccccagaggcatactgccagcagcgagtgttccgctcactggcctacatgcggccactgagcatatgggccatgcagctagccctgcaacagcagcagcacaaaaaggcctcctggccaaaagtcaaacagggcacaggactaaggacagggcctatgtttggaccaaaggaagccatggcaaacctgagcccagagtgagccgtctgaactgtgggagggaagtgctaacagcccagcctccagcctggcctttcctccttcccctctgaacctcctgcaaccctgagccatcaggacaatcataccccttcccttctctccacccaattgtgccagtaaatgggggttgagggtgacctaggcagcattagaatcacttatttatttctttcctcacctgttccctgactgcgtgaaatgttcagggaggtcagttgatttccccaggtacattcatggtgtgacagacacatgggtacaaataaaagacccagaaagcc

SEQ ID NO: 2605 - DNA, 3757 bp, Homo sapiens
gggctcgggtcatcccggcgcccagggtcaccttcccacgggctggcacctgggcgcgggcgctgccccggagccggccggcgggacctggcgcccaatcctgggggacccggtgccgtggcccaggggccgggccgaggtcccgggggcggtgccttgcgggcccgtcccggggcggtgcctggtgggctggccccgcggctcctcccctctctgcgggcccagtcgccctttggccgggcgagctaatcgtcggctcaatgacgacgaggcccgacccttcccgtccaggacctacagagacaaccgaaggagagcccaaggcggcttctttgctgtcgccgcccccactgaagcaagagctccccggctccactgaaacaccagctcatttaagctttccccaacgcccggccctccgggacgatacctaacaacgaccggcgcccgcatctggaataggctggcgagatacttagtatccgagggctcgggacttggcgccatcgaggtcatggggacccaggatccagggaacatgggaaccggcgtcccagcctcggagcagataagctgtgccaaagaggatccacaagtttattgccctgaagagactggcggcaccaaggatgtgcaggttacagactgtaagagtcccgaagacagccgacccccaaaagagacggactgctgcaatccggaggactctgggcagctgatggtttcctatgagggtaaagctatgggctaccaggtgcctccctttggctggcgcatctgtctggctcatgagtttacagagaagaggaaaccctttcaagctaacaacgtctccctaagcaacatgataaagcatataggcatgggcttgaggtacctgcagtggtggtaccggaagacccatgtggaaaagaagacacctttcatcgacatgatcaattctgtacccctaagacagatttatggttgtcccttgggtggcatcgggggaggcactattacccgtggctggagaggccagttctgtcgttggcagcttaaccctggaatgtatcagcaccggacagtcatcgctgaccaattcacagtgtgcctgcgtcgggaagggcagactgtgtaccagcaagtcctgtccctggagcgcccaagtgtcctccgcagctggaactggggcctgtgtgggtactttgctttctaccatgccctctatccccgagcctggactgtctatcagcttcctggccagaatgtcaccctcacctgccgtcagatcacacccatcttgccccatgactaccaggacagcagcctgcctgtaggagtctttgtgtgggatgtggaaaatgaaggggacgaagctctagatgtgtccatcatgttctccatgcggaatggactgggtggtggagacgatgccccagggggtttgtggaatgagcccttctgtctggagcgtagcggggaaactgtccgggggctgctcctgcatcatccaacccttccaaacccctacacgatggctgtggctgcacgagtcacggcagctaccacggtaacccacatcacagcctttgaccctgacagcacggggcagcaggtgtggcaggatctacttcaggatggacagctggactctcccactggccaaagcacccctacgcagaaaggagtaggcattgctggagctgtgtgtgtttccagcaagttgcgacctcgaggccagtgccgcctggagttttcactggcttgggacatgcccaggatcatgtttggagctaaaggccaagtccactacaggcggtatacaaggttctttggccaggatggagatgcagcacctgccctcagccactatgcactgtgccgatacgcagagtgggaagagaggatctcagcttggcagagcccggtattggatgacagatcactgcctgcctggtacaaatctgcgctgttcaatgaactatacttcctggctgatggaggcacagtgtggctggaagttcttgaggactccctaccagaggagctgggcagaaacatgtgtcacctccgccccaccctacgggactacggtcgatttggctaccttgagggccaggagtaccgcatgtacaacacatatgatgtccacttttatgcttcctttgccctcatcatgctctggcccaaacttgagctcagcctacagtatgacatggctctggccactctcagggaggacctgacacggcgacggtacctgatgagtggggtgatggcacctgtgaaaaggaggaacgtcatcccccatgatattggggacccagatgatgaaccatggctccgcgtcaatgcatatttaatccatgatactgctgattggaaggacctgaacctgaagtttgtgctgcaggtttatcgggactattacctcacgggtgatcaaaacttcctgaaggacatgtggcctgtgtgtctagctgtgatggaatctgaaatgaagtttgacaaggaccatgatggactcattgaaaatggaggctatgcagaccagacctatgatggatgggtgaccacaggccccagtgcttactgtggagggctgtggctggcagctgtggctgtgatggtccagatggctgctctgtgtggggcacaggacatccaggataagttttcttctatcctcagccggggccaagaagcctatgagagactgctgtggaatggccgctattacaactatgacagcagctctcggcctcagtctcgtagtgttatgtctgaccagtgtgctggacagtggttcctgaaggcctgtggcctaggagaaggagacactgaggtgtttcctacccaacatgtggtccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagagctcctgccttcaggcttctgtctgtgggtcatagttatctcctccacttgctgggagctccttgaaggcaaagactctactgcctccatctatccagtggaagtggctcttcagagggtgccaagttagtatgtatgactgtcatctctcccaacagggcctgacttgggagggcttccagacagctgaaggctgctaccgtaccgtgtgggagcgcctgggtctggccttccagaccccagaggcatactgccagcagcgagtgttccgctcactggcctacatgcggccactgagcatatgggccatgcagctagccctgcaacagcagcagcacaaaaaggcctcctggccaaaagtcaaacagggcacaggactaaggacagggcctatgtttggaccaaaggaagccatggcaaacctgagcccagagtgagccgtctgaactgtgggagggaagtgctaacagcccagcctccagcctggcctttcctccttcccctctgaacctcctgcaaccctgagccatcaggacaatcataccccttcccttctctccacccaattgtgccagtaaatgggggttgagggtgacctaggcagcattagaatcacttatttatttctttcctcacctgttccctgactgcgtgaaatgttcagggaggtcagttgatttccccaggtacattcatggtgtgacagacacatgggtacaaataaaagacccagaaagcc

SEQ ID NO: 2606 - DNA, 3611 bp, Homo sapiens
agaccggaaagggctcgggtcatcccggcgcccagggtcaccttcccacgggctggcacctgggcgcgggcgctgccccggagccggccggcgggacctggcgcccaatcctgggggacccggtgccgtggcccaggggccgggccgaggtcccgggggcggtgccttgcgggcccgtcccggggcggtgcctggtgggctggccccgcggctcctcccctctctgcgggcccagtcgccctttggccgggcgagctaatcgtcggctcaatgacgacgaggcccgacccttcccgtccaggacctacagagacaaccgaaggagagcccaaggcggcttctttgctgtcgccgcccccactgaagcaagagctccccggctccactgaaacaccagctcatttaagctttccccaacgcccggccctccgggacgatacctaacaacgaccggcgcccgcatctggaataggctggcgagatacttagtatccgagggctcgggacttggcgccatcgaggtcatggggacccaggatccagggaacatgggaaccggcgtcccagcctcggagcagataagctgtgccaaagaggatccacaagtttattgccctgaagagactggcggcaccaaggatgtgcaggttacagactgtaagagtcccgaagacagccgacccccaaaagagacggactgctgcaatccggaggactctgggcagctgatggtttcctatgagggtaaagctatgggctaccaggtgcctccctttggctggcgcatctgtctggctcatgagtttacagagaagaggaaaccctttcaagctaacaacgtctccctaagcaacatgataaagcatataggcatgggcttgaggtacctgcagtggtggtaccggaagacccatgtggaaaagaagacacctttcatcgacatgatcaattctgtacccctaagacagatttatggttgtcccttgggtggcatcgggggaggcactattacccgtggctggagaggccagttctgtcgttggcagcttaaccctggaatgtatcagcaccggacagtcatcgctgaccaattcacagtgtgcctgcgtcgggaagggcagactgtgtaccagcaagtcctgtccctggagcgcccaagtgtcctccgcagctggaactggggcctgtgtgggtactttgctttctaccatgccctctatccccgagcctggactgtctatcagcttcctggccagaatgtcaccctcacctgccgtcagatcacacccatcttgccccatgactaccaggacagcagcctgcctgtaggagtctttgtgtgggatgtggaaaatgaaggggacgaagctctagatgtgtccatcatgttctccatgcggaatggactgggtggtggagacgatgccccagggggtttgtggaatgagcccttctgtctggagcgtagcggggaaactgtccgggggctgctcctgcatcatccaacccttccaaacccctacacgatggctgtggctgcacgagtcacggcagctaccacggtaacccacatcacagcctttgaccctgacagcacggggcagcaggtgtggcaggatctacttcaggatggacagctggactctcccactggccaaagcacccctacgcagaaaggagtaggcattgctggagctgtgtgtgtttccagcaagttgcgacctcgaggccagtgccgcctggagttttcactggcttgggacatgcccaggatcatgtttggagctaaaggccaagtccactacaggcggtatacaaggttctttggccaggatggagatgcagcacctgccctcagccactatgcactgtgccgatacgcagagtgggaagagaggatctcagcttggcagagcccggtattggatgacagatcactgcctgcctggtacaaatctgcgctgttcaatgaactatacttcctggctgatggaggcacagtgtggctggaagttcttgaggactccctaccagaggagctgggcagaaacatgtgtcacctccgccccaccctacgggactacggtcgatttggctaccttgagggccaggagtaccgcatgtacaacacatatgatgtccacttttatgcttcctttgccctcatcatgctctggcccaaacttgagctcagcctacagtatgacatggctctggccactctcagggaggacctgacacggcgacggtacctgatgagtggggtgatggcacctgtgaaaaggaggaacgtcatcccccatgatattggggacccagatgatgaaccatggctccgcgtcaatgcatatttaatccatgatactgctgattggaaggacctgaacctgaagtttgtgctgcaggtttatcgggactattacctcacgggtgatcaaaacttcctgaaggacatgtggcctgtgtgtctagctgtgatggaatctgaaatgaagtttgacaaggaccatgatggactcattgaaaatggaggctatgcagaccagacctatgatggatgggtgaccacaggccccagtgcttactgtggagggctgtggctggcagctgtggctgtgatggtccagatggctgctctgtgtggggcacaggacatccaggataagttttcttctatcctcagccggggccaagaagcctatgagagactgctgtggaatggccgctattacaactatgacagcagctctcggcctcagtctcgtagtgttatgtctgaccagtgtgctggacagtggttcctgaaggcctgtggcctaggagaaggagacactgaggtgtttcctacccaacatgtggtccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagagggcctgacttgggagggcttccagacagctgaaggctgctaccgtaccgtgtgggagcgcctgggtctggccttccagaccccagaggcatactgccagcagcgagtgttccgctcactggcctacatgcggccactgagcatatgggccatgcagctagccctgcaacagcagcagcacaaaaaggcctcctggccaaaagtcaaacagggcacaggactaaggacagggcctatgtttggaccaaaggaagccatggcaaacctgagcccagagtgagccgtctgaactgtgggagggaagtgctaacagcccagcctccagcctggcctttcctccttcccctctgaacctcctgcaaccctgagccatcaggacaatcataccccttcccttctctccacccaattgtgccagtaaatgggggttgagggtgacctaggcagcattagaatcacttatttatttctttcctcacctgttccctgactgcgtgaaatgttcagggaggtcagttgatttccccaggtacattcatggtgtgacagacacatgggtacaaataaaagacccagaaagcca

SEQ ID NO: 2607 - DNA, 3527 bp, Homo sapiens
acagtgagcaagaggaggtggtgtcgctacaggacaacctgagctctgcctcagccccagagataatctggcttcttcccagaagggccaccaccttcagtgccagcatccccacctggatgcagaagtggccgtgggcggaagggggttggtgacggtcactacacactccagcgcctccccagccaaaaatacaggaccccggctgagctctgctaccacttcaatcatggcagctccggaatcagatctagaaggaaacaaggcggggcggaggacctacagagacaaccgaaggagagcccaaggcggcttctttgctgtcgccgcccccactgaagcaagagctccccggctccactgaaacaccagctcatttaagctttccccaacgcccggccctccgggacgatacctaacaacgaccggcgcccgcatctggaataggctggcgagatacttagtatccgagggctcgggacttggcgccatcgaggtcatggggacccaggatccagggaacatgggaaccggcgtcccagcctcggagcagataagctgtgccaaagaggatccacaagtttattgccctgaagagactggcggcaccaaggatgtgcaggttacagactgtaagagtcccgaagacagccgacccccaaaagagacggactgctgcaatccggaggactctgggcagctgatggtttcctatgagggtaaagctatgggctaccaggtgcctccctttggctggcgcatctgtctggctcatgagtttacagagaagaggaaaccctttcaagctaacaacgtctccctaagcaacatgataaagcatataggcatgggcttgaggtacctgcagtggtggtaccggaagacccatgtggaaaagaagacacctttcatcgacatgatcaattctgtacccctaagacagatttatggttgtcccttgggtggcatcgggggaggcactattacccgtggctggagaggccagttctgtcgttggcagcttaaccctggaatgtatcagcaccggacagtcatcgctgaccaacctatctgccctcttaagttcacagtgtgcctgcgtcgggaagggcagactgtgtaccagcaagtcctgtccctggagcgcccaagtgtcctccgcagctggaactggggcctgtgtgggtactttgctttctaccatgccctctatccccgagcctggactgtctatcagcttcctggccagaatgtcaccctcacctgccgtcagatcacacccatcttgccccatgactaccaggacagcagcctgcctgtaggagtctttgtgtgggatgtggaaaatgaaggggacgaagctctagatgtgtccatcatgttctccatgcggaatggactgggtggtggagacgatgccccagggggtttgtggaatgagcccttctgtctggagcgtagcggggaaactgtccgggggctgctcctgcatcatccaacccttccaaacccctacacgatggctgtggctgcacgagtcacggcagctaccacggtaacccacatcacagcctttgaccctgacagcacggggcagcaggtgtggcaggatctacttcaggatggacagctggactctcccactggccaaagcacccctacgcagaaaggagtaggcattgctggagctgtgtgtgtttccagcaagttgcgacctcgaggccagtgccgcctggagttttcactggcttgggacatgcccaggatcatgtttggagctaaaggccaagtccactacaggcggtatacaaggttctttggccaggatggagatgcagcacctgccctcagccactatgcactgtgccgatacgcagagtgggaagagaggatctcagcttggcagagcccggtattggatgacagatcactgcctgcctggtacaaatctgcgctgttcaatgaactatacttcctggctgatggaggcacagtgtggctggaagttcttgaggactccctaccagaggagctgggcagaaacatgtgtcacctccgccccaccctacgggactacggtcgatttggctaccttgagggccaggagtaccgcatgtacaacacatatgatgtccacttttatgcttcctttgccctcatcatgctctggcccaaacttgagctcagcctacagtatgacatggctctggccactctcagggaggacctgacacggcgacggtacctgatgagtggggtgatggcacctgtgaaaaggaggaacgtcatcccccatgatattggggacccagatgatgaaccatggctccgcgtcaatgcatatttaatccatgatactgctgattggaaggacctgaacctgaagtttgtgctgcaggtttatcgggactattacctcacgggtgatcaaaacttcctgaaggacatgtggcctgtgtgtctagctgtgatggaatctgaaatgaagtttgacaaggaccatgatggactcattgaaaatggaggctatgcagaccagacctatgatggatgggtgaccacaggccccagtgcttactgtggagggctgtggctggcagctgtggctgtgatggtccagatggctgctctgtgtggggcacaggacatccaggataagttttcttctatcctcagccggggccaagaagcctatgagagactgctgtggaatggccgctattacaactatgacagcagctctcggcctcagtctcgtagtgttatgtctgaccagtgtgctggacagtggttcctgaaggcctgtggcctaggagaaggagacactgaggtgtttcctacccaacatgtggtccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagagggcctgacttgggagggcttccagacagctgaaggctgctaccgtaccgtgtgggagcgcctgggtctggccttccagaccccagaggcatactgccagcagcgagtgttccgctcactggcctacatgcggccactgagcatatgggccatgcagctagccctgcaacagcagcagcacaaaaaggcctcctggccaaaagtcaaacagggcacaggactaaggacagggcctatgtttggaccaaaggaagccatggcaaacctgagcccagagtgagccgtctgaactgtgggagggaagtgctaacagcccagcctccagcctggcctttcctccttcccctctgaacctcctgcaaccctgagccatcaggacaatcataccccttcccttctctccacccaattgtgccagtaaatgggggttgagggtgacctaggcagcattagaatcacttatttatttctttcctcacctgttccctgactgcgtgaaatgttca

SEQ ID NO: 2608 - DNA, 3636 bp, Homo sapiens
atggccaccactgccacgccggccacgaaccagggctggccagaggactttggcttccggctaggtggctctggcccctgcttcgtcctggaggtggccaaggggagcagcgcgcatgccggaggactgcggccaggagaccagatcctggaggtggaggggctggcggtgggcggtctgagccgcgagcgcctcgtgcgcctggcacggcgctgcccacgtgtgccgcccagtctgggcgtgctcccggctcccgacggtggccccggcccaggatccggccccgcggccccgaccacagtcttgcgggccccgcggtgcggccgcggcctagctctgggccgtgagctgcttcgcctggccggccgcaagcgcccggacgcggtgcaccgagagcgcaggcgcaaggcccaagagttcagccgcaaggtggatgaaatcttgggggaccagccaactgccaaggagcaggtgttcgctgcactgaagcagtttgcagctgagcagcgggtggatgatctggtgtggactctcaccctggcgctgccccgagaggcctgcgggccactcctggacaacctcaggatcttcatccccaagaagcaccgggcgcgcttcgacgaggtggtgtctcagggcctcctgggcaagctgtgccgcgcacgccgggcccagggcgcgcagcgactgcgccggagccgcagcgaggagcggccggagcgcctcctggtgtccacgcgcgccagcgccccgccgcgccgccccgatgagccgcccccgcgcagggcctccttgctggtgggcggcctcgccggccccgggggcgcgcgcaggactgtccgagtctacaaaggcaacaagagcttcggcttcacacttcgcggccacgggcctgtctggatcgagtctgtcctgcctgggagcccagctgacaatgctgccctcaagtcaggtgaccggatcctcttcctcaatggactggacatgaggaactgctcccacgacaaggtggtgtccatgctgcagggcagtggtgccatgcccacgctggtggtggaggaagggctcgtcccatttgccagtgactccgattctctggactcacccaacccgtcgtcggcgctcacctccctgcagtgggtggcggagatcctgccgtccagcatccgggtccaagggaggaccttcagccagcagctggagcacctactcacacctcctgagcgctatggggtctgccgggccctcgagagcttcttccagcacaggaacatcgacaccctcatcgttgacgtctaccctgtgctggacacccctgccaagcaggtcctgtggcagttcatctaccagctgctgacctatgaggagcaggagctctgtcaggagaaaatcgcatgcttcctgggctacacggccatgacagcagagccggagcctgagctggacctggagtccgagcccacgcctgagccccagccgcggagctccctgcgggcttcctccatgtgccgccgcagcctccggtcccagggcctggaggccggcctcagctgcggtcccagcgagtgccctgagatgcctcttcccctgatcccaggcgagcgccaggcaggcgacggcacgtccctccctgagacccccaaccccaagatgatgtcagccgtctatgcagagcttgagtctcgactgaacagcagcttcaaagggaagatggggaccgtgtccaaatcccgggcttcccctccaggccccagcccagcagtcaccacagggcccaggaccctgtccggcgtctcatggcccagcgagcgactcttgccctccccctgctaccacccgctgtgttcggggggtctggcctcccccagcagctctgagtcccacccctacgccagcctggacagcagcagggcaccctccccacagccaggccccgggcccatctgccccgacagccccccaagcccggaccccacccgcccgcccagccgcaggaagctcttcaccttctcccaccctgtgcgaagccgcgatactgaccgcttcctggacgtgctgagcgagcagctgggcccccgggtcaccatcgtggatgatttcctgaccccggagaacgactacgaggagatgagcttccatgatgaccagggcagcttcgtaaccaatgagcggagcagcgccagcgactgcatcagcagcagtgaagaaggcagctccctgacctactcctccatctctgaccacatccccccacccccgctcagccccccaccaccgccacccctgcctttccatgacgctaagcccagctcccgcagctctgatggttcccggggccctgctcaggcgctggccaagcccctcacccaactcagccacccagtccctccaccacccccaccgcccctgcccccacccgtgccctgtgcaccccccatgctgtcccggggcctgggccaccggcgcagtgagaccagccacatgagcgtcaagcgcttgcggtgggaacaggtggagaactcagaaggcaccatctggggtcagctcggggaagactctgactacgataagctgagtgacatggtgaaatacctcgacctggagctccacttcggcacccagaaacctgctaaaccggtgccggggccggagcccttccggaagaaggaggtggtggagatcctgtcccataagaaggcctacaacacctccatcctcttggcacacctgaagctgagccccgcggagctgcgccaggtgctgatgagcatggagccccggcgcctggagcccgcacatctcgcgcagctgctgctcttcgcgcccgacgccgacgaggagcagcgctaccaggccttccgcgaggcgcccggccgcctcagcgagccggaccagttcgtcctgcagatgctgtcagttcccgaatacaagacacgcctgcgcagcctccacttccaggccaccctccaggagaagacagaggagatccgaggcagccttgaatgcttgcgccaggcctccctggagctcaaaaacagtcggaagctcgccaagatcctggagtttgtgttggccatgggcaactatctcaacgatggacagcccaaaaccaacaagactacgggcttcaagatcaactttctgacagagctgaactccaccaagacagtggatgggaagtccaccttcctgcacatccttgccaaatcgctgagccagcacttccctgaactcctgggctttgctcaggacctgcccaccgtgcccctggctgccaaagtgaaccaacgggccctgaccagtgacctggctgacctccatggcactatcagcgagatacaggatgcctgccagagcatttccccctctagcgaggacaagtttgcaatggtcatgtcgtccttcctggagacggcccagccagcacttcgggcgctcgacgggctgcagcgcgaggccatggaggagctgggcaaggcgctggccttctttggggaggattccaaggccaccacctctgaggctttcttcggcatctttgcagagttcatgagcaaattcgagcgagcgctgagtgacctgcaggccggggagggcctgcgcagctccgggatggtttcacccctggcctggtga

SEQ ID NO: 2609 - DNA, 3281 bp, Homo sapiens
cgacgccgacaactttgcgatggagtttgtgcgggcgctgtggctgggcctggcgctggcgctggggccggggtccgcggggggccaccctcagccgtgcggcgtcctggcgcgcctcgggggctccgtgcgcctgggcgccctcctgccccgcgcgcctctcgcccgcgcccgcgcccgcgccgccctggcccgggccgccctggcgccgcggctgccgcacaacctgagcttggagctggtggtcgccgcgccccccgcccgcgaccccgcctcgctgacccgcggcctgtgccaggcgctggtgcctccgggcgtggcggccctgctcgcctttcccgaggctcggcccgagctgctgcagctgcacttcctggcggcggccaccgagacccccgtgctcagcctgctgcggcgggaggcgcgcgcgcccctcggagccccgaacccattccacctgcagctgcactgggccagccccctggagacgctgctggatgtgctggtggcggtgctgcaggcgcacgcctgggaagacgtcggcctggccctgtgccgcactcaggaccccggcggcctggtggccctctggacaagccgggctggccggcccccacagctggtcctggacctaagccggcgggacacgggagatgcaggactgcgggcacgcctggccccgatggcggcgccagtggggggtgaagcaccggtacccgcggcggtcctcctcggctgtgacatcgcccgtgcccgtcgggtgctggaggccgtacctcccggcccccactggctgttggggacaccactgccgcccaaggccctgcccaccgcggggctgccaccagggctgctggcgctgggcgaggtggcacgacccccgctggaggccgccatccatgacattgtgcaactggtggcccgggcgctgggcagtgcggcccaggtgcagccgaagcgagccctcctccccgccccggtcaactgcggggacctgcagccggccgggcccgagtccccggggcgcttcttggcacggttcctggccaacacgtccttccagggccgcacgggccccgtgtgggtgacaggcagctcccaggtacacatgtctcggcactttaaggtgtggagccttcgccgggacccacggggcgccccggcctgggccacggtgggcagctggcgggacggccagctggacttggaaccgggaggtgcctctgcacggcccccgcccccacagggtgcccaggtctggcccaagctgcgtgtggtaacgctgttggaacacccatttgtgtttgcccgtgatccagacgaagacgggcagtgcccagcggggcagctgtgcctggaccctggcaccaacgactcggccaccctggacgcactgttcgccgcgctggccaacggctcagcgccccgtgccctgcgcaagtgctgctacggctactgcattgacctgctggagcggctggcggaggacacgcccttcgacttcgagctgtacctcgtgggtgacggcaagtacggcgccctgcgggacggccgctggaccggcctggtcggggacctgctggccggccgggcccacatggcggtcaccagcttcagtatcaactccgcccgctcacaggtggtggacttcaccagccccttcttctccaccagcctgggcatcatggtgcgggcacgggacacggcctcacccatcggtgcctttatgtggcccctgcactggtccacgtggctgggcgtctttgcggccctgcacctcaccgcgctcttcctcaccgtgtacgagtggcgtagcccctacggcctcacgccacgtggccgcaaccgcagcaccgtcttctcctactcctcagccctcaacctgtgctacgccatcctcttcagacgcaccgtgtccagcaagacgcccaagtgccccacgggccgcctgctcatgaacctctgggccatcttctgcctgctggtgctgtccagctacacggccaacctggctgccgtcatggtcggggacaagaccttcgaggagctgtcggggatccacgaccccaagctgcaccacccggcgcagggcttccgcttcggcaccgtgtgggagagcagcgccgaggcgtacatcaagaagagcttccccgacatgcacgcacacatgcggcgccacagcgcgcccaccacgccccgcggcgtcgccatgctcacgagcgacccccccaagctcaacgccttcatcatggacaagtcgctcctggactacgaggtctccatcgacgccgactgcaaactgctgaccgtgggaaagcccttcgccattgagggctatgggatcggactgccccagaactcgccgctcacctccaacctgtccgagttcatcagccgctacaagtcctccggcttcatcgacctgctccacgacaagtggtacaagatggtgccttgcggcaagcgggtctttgcggttacagagaccctgcagatgagcatctaccacttcgcgggcctcttcgtgttgctgtgcctgggcctgggcagcgctctgctcagctcgctgggcgagcacgccttcttccgcctggcgctgccgcgcatccgcaaggggagcaggctgcagtactggctgcacaccagccagaaaatccaccgcgccctcaacacggagccaccagaggggtcgaaggaggagacggcagaggcggagcccagcggccccgaggtggagcagcagcagcagcagcaggaccagccaacggctccggagggctggaaacgggcgcgccgggccgtggacaaggagcgccgcgtgcgcttcctgctggagcccgccgtggttgtggcacccgaagcggacgcggaggcggaggctgcgccgcgagagggccccgtctggctgtgctcctacggccgcccgcccgccgcaaggcccacgggggccccccagcccggggagctgcaggagctggagcgccgcatcgaagtcgcgcgtgagcggctccgccaggccctggtgcggcgcggccagctcctggcacagctcggggacagcgcacgtcaccggcctcggcgcttgcttcaggccagagcggcccccgcggaggccccaccacactctggccgaccggggagccaggaatgaggcggcagccgggccgtttgggctcaagacacacacacagcgcagtgagccgctgtcaacagacagtttattctatatacaaacacaattttgtacactgcaattaaatagaatggaatgagcgctcctc

SEQ ID NO: 2610 - DNA, 4475 bp, Homo sapiens
acaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtgatccgaaagggagaagtcagctgttgttggacctgtacaccttgtaaggagaatgagtatgtctttgatgagtacacatgcaaggcatgccaactggggtcttggcccactgatgatctcacaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggaggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaagatgccaagggcaccccttaatggaaacacgagatcagtagtgctatctcatgacaaccgacgaagaaaccgacgacaaatcttttggcagattttcttctagtggccttagaaaacatgggcttttaagaaacacggctgatatctttgagggctgacaaggcgtctcttcaaacagttccataccaagtgctttgctctagggaagcagtgcgtgtgaaacagcgtaacggagggtgaagagcatagttaataagcaactgtaaaaagttttatttgtttactttaattcttttcccagaagagtctttgattcaccaaacatgaatgtacattttctaacaaactcaaaatctgggaccaaaacatcaacttttttctttcttttttctttctttttgttttttctttcctgtaaagaccttgaaaagcagtaacttgggtccagtatttacggaggcgttgtgaatgtgtcccatgcataacacactactggatagtgagtgctgcgctaatgtactacgtagggcttctaccagagattttcctctccaattgggttgtgaaatactcttccaaaagcctgcatcggggattccacctacttatttcagattcacctccattaaccaagaaaaccagtggaagatttcttgactatttcaccatgttgccaatc

SEQ ID NO: 2611 - DNA, 4571 bp, Homo sapiens
acaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtgatccgaaagggagaagtcagctgttgttggacctgtacaccttgtaaggagaatgagtatgtctttgatgagtacacatgcaaggcatgccaactggggtcttggcccactgatgatctcacaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaaggtacaaagacaggagactggcccagcacaagtcggaaatagagtgtttcacccccaaagggagtatggggaatggtgggagagcaacaatgagcagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggaggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaagatgccaagggcaccccttaatggaaacacgagatcagtagtgctatctcatgacaaccgacgaagaaaccgacgacaaatcttttggcagattttcttctagtggccttagaaaacatgggcttttaagaaacacggctgatatctttgagggctgacaaggcgtctcttcaaacagttccataccaagtgctttgctctagggaagcagtgcgtgtgaaacagcgtaacggagggtgaagagcatagttaataagcaactgtaaaaagttttatttgtttactttaattcttttcccagaagagtctttgattcaccaaacatgaatgtacattttctaacaaactcaaaatctgggaccaaaacatcaacttttttctttcttttttctttctttttgttttttctttcctgtaaagaccttgaaaagcagtaacttgggtccagtatttacggaggcgttgtgaatgtgtcccatgcataacacactactggatagtgagtgctgcgctaatgtactacgtagggcttctaccagagattttcctctccaattgggttgtgaaatactcttccaaaagcctgcatcggggattccacctacttatttcagattcacctccattaaccaagaaaaccagtggaagatttcttgactatttcaccatgttgccaatc

SEQ ID NO: 2612 - DNA, 2829 bp, Homo sapiens
atggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtgatccgaaagggagaagtcagctgttgttggacctgtacaccttgtaaggagaatgagtatgtctttgatgagtacacatgcaaggcatgccaactggggtcttggcccactgatgatctcacaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaaggtacaaagacaggagactggcccagcacaagtcggaaatagagtgtttcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtga

SEQ ID NO: 2613 - DNA, 8023 bp, Homo sapiens
agctcggctgttctgcgcacgctgagcggagggaatgagcttgagatcatcttgggggggaagccggggactggagaggccggctctgccctgctgatccccgtggcccaacttttcggggggctagctagaccgagtctcactgctcgcagcgcagccaacaggggggtttagaagatcatgaccacatggatcatctaactaaatggtacatggggacaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtgatccgaaagggagaagtcagctgttgttggacctgtacaccttgtaaggagaatgagtatgtctttgatgagtacacatgcaaggcatgccaactggggtcttggcccactgatgatctcacaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaaggtacaaagacaggagactggcccagcacaagtcggaaatagagtgtttcacccccaaagggagtatggggaatggtgggagagcaacaatgagcagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggaggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaagatgccaagggcaccccttaatggaaacacgagatcagtagtgctatctcatgacaaccgacgaagaaaccgacgacaaatcttttggcagattttcttctagtggccttagaaaacatgggcttttaagaaacacggctgatatctttgagggctgacaaggcgtctcttcaaacagttccataccaagtgctttgctctagggaagcagtgcgtgtgaaacagcgtaacggagggtgaagagcatagttaataagcaactgtaaaaagttttatttgtttactttaattcttttcccagaagagtctttgattcaccaaacatgaatgtacattttctaacaaactcaaaatctgggaccaaaacatcaacttttttctttcttttttctttctttttgttttttctttcctgtaaagaccttgaaaagcagtaacttgggtccagtatttacggaggcgttgtgaatgtgtcccatgcataacacactactggatagtgagtgctgcgctaatgtactacgtagggcttctaccagagattttcctctccaattgggttgtgaaatactcttccaaaagcctgcatcggggattccacctacttatttcagattcacctccattaaccaagaaaaccagtggaagatttcttgactatttcaccatgttgccaatcaatactggagtagcaaaaaaaatattttctggaatactgttttgtaattccctcactggggtgcattgtagctggaaattctctttataaaaatcattcttgagctccagcctggctatctctttcaagaaacatggccactctttaggaatgctgttgcgtttgcattgccaactaaaatattaaaatatgcattggggcttcttcattcctttattttgagaacctgatgcacaaagagctcctttgttcttttcgagtcccaccactggaagagtggtccatagaccccatgaagacattgtcatgatttgagagactgttgttgaaaggattaacacaatcttaatacactgaaaattttaactgtgtcaagtcagcttagtggagatttagctatgccagtgagcagtgattttaactattcttggctgcttaaacagggcagctatgaactatgacaaatgtagatttttcaaagcaatacaaaatactaaaaaagaggaaccttaatgaatattaaccacacagtctttcttagccattccaaaaagaggcaaagcaattcttattttcttttttaaaataatgattaatatgattttgtgcacttcatactgtcactttttaaaactacagaaaagagatttagagtataacagaaacaagtgtgctttgatagtctcaaataggtagaattcatagttcaagacctgaatccactgtcatctctttcttcctcccattgcagctatcctcaggtaccaaatgttttgatttttaaataaggatagtaataaatggaggaggtgtcctataaatttaaagttcagttgacccagccttatacttaagatagccttatgaaaaatatgtgctgtgaggcagaagtatattttggcagagagaataataaataaaactttttcttttagctcaatatccttactttggtaagtatttttttttatttcacatctacttaacagaaaataaactgagaaatagaagtcagtccattggcataatttatcattcttcactttaaaaaattctaataaatattctgcttgagttttcttttctgctatttgttcttacttgcaactttaagtcaaacctcccaatacaaaacattaaaagctaacattaatgtactaaagtattaatttaaaagaaatcgaacctcccatgctagatttgaaaataacatcatcacagcaccctgatcccaaatattacaccgaggcttttaaaatgtaagtgaaatctagctaagtttcatggtttcattaaaagcaaatgtctgcctctatctgaaaaacaaatggaaatcttttgaggtgttaataccctttggatcctcatcaaaaggatggcattcacctgaggattcctatcttgacttcttaggtattaaaaacctttcttgatatgctctacattttaaaatttgttttataaaatccttatgttgattttcattttattctcaagtacaatacgtttcactctagaccagttgaagaacatgtttaaactttgttcatggtcaaattcattttctatttttttagtaacatatctcttaaaaagcacactaccttataaaaaacttcatcagaaattaaatttaatgcaagtaaattgccatctgatacttccacatgctatcataatcaactgtaataataaaaatgatttatccaattagaaaaggacaagatatatttttctctgtatttctataacttttgccactccattgaatacattgtatgttggacataagattattagtaatgcattcttgagatcttttattttggaatgatgctaactctgtctctttgccaattctaataccaggttccaagtaataactctacagtacaaagagaactgaatattcattctagggctataggatatgaacttcacaattcatttgggtacattctcattgaatttccttcaaaacaatctgttcctggtgcccagtgataattcagtcgggaccagcatgactaaaaggaaggggatatgctaaggctcagcaaagtgaccctaaatgagagatatgtcccaggatggaaagaagaagacgtggtttaaccaagttatactgactaatctaagcagtccactcatccttccattttgggaaaggagtgggggcagcctaagaagaacatatctggattgggaagaaccgtctttctgggctagggatggggaacagaaagggagtatggaaagaaaaattataagagatttgactgaagcaaggaaaaaaagcaaatccccaaacgtgctaatccttgaaagtaactatctttcccaaactactgctgttaccagcaagtgatcaggaagactaggagctatttctgactgtaaatgaattgtataatagctctgctgcagttctgtgacttccaagccaggaattaaatgctctttttaagaataacaaaaaacaaaagcatttcctatgctagtctcccagtaaaatgtacatgttttggagacttcaaaggtattatgtgagttcacatttagcaacagcttattaataaccctcaagctgtcagaatctctatagttaccatttacaattttatactgtgaaaaaatacagatcagtgaaagcataaagacaagtcagaattcactttgaagagggtctgaggcctgggagagtctctactgtctattgaagaatgaggcatgtataaaatagttggttgaatttcactgatcttcccaatgtgaacaaatatactatgtatattgtgtgtatttctagaaatcaatggcagctgctgatggtgttgtaattagaaatctatatagattatagatgttttagaaagatggtgccaatcctaaaagatttgtgtgggctaaaagtgcttgtacttacttttttctgcacttataactgatttggttttaaaattgtgtgcgtgtatctgttctttctctgttgtggcagcttgtactattaaaataatagagaatgttaaattattttgatgtgaactgcaaatgattttttttcataaagtttaacatttttatcagcattgttttgctttgtacttgtataaatatgttttattttagcacttcaaaatatacttgcctgtttctcagttgtctaaatcatgttgtacttggtgtttgtgaagccagttacttttcaaaaaaattaaaaaacctataatatga

SEQ ID NO: 2614 - DNA, 7927 bp, Homo sapiens
agctcggctgttctgcgcacgctgagcggagggaatgagcttgagatcatcttgggggggaagccggggactggagaggccggctctgccctgctgatccccgtggcccaacttttcggggggctagctagaccgagtctcactgctcgcagcgcagccaacaggggggtttagaagatcatgaccacatggatcatctaactaaatggtacatggggacaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtgatccgaaagggagaagtcagctgttgttggacctgtacaccttgtaaggagaatgagtatgtctttgatgagtacacatgcaaggcatgccaactggggtcttggcccactgatgatctcacaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggaggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaagatgccaagggcaccccttaatggaaacacgagatcagtagtgctatctcatgacaaccgacgaagaaaccgacgacaaatcttttggcagattttcttctagtggccttagaaaacatgggcttttaagaaacacggctgatatctttgagggctgacaaggcgtctcttcaaacagttccataccaagtgctttgctctagggaagcagtgcgtgtgaaacagcgtaacggagggtgaagagcatagttaataagcaactgtaaaaagttttatttgtttactttaattcttttcccagaagagtctttgattcaccaaacatgaatgtacattttctaacaaactcaaaatctgggaccaaaacatcaacttttttctttcttttttctttctttttgttttttctttcctgtaaagaccttgaaaagcagtaacttgggtccagtatttacggaggcgttgtgaatgtgtcccatgcataacacactactggatagtgagtgctgcgctaatgtactacgtagggcttctaccagagattttcctctccaattgggttgtgaaatactcttccaaaagcctgcatcggggattccacctacttatttcagattcacctccattaaccaagaaaaccagtggaagatttcttgactatttcaccatgttgccaatcaatactggagtagcaaaaaaaatattttctggaatactgttttgtaattccctcactggggtgcattgtagctggaaattctctttataaaaatcattcttgagctccagcctggctatctctttcaagaaacatggccactctttaggaatgctgttgcgtttgcattgccaactaaaatattaaaatatgcattggggcttcttcattcctttattttgagaacctgatgcacaaagagctcctttgttcttttcgagtcccaccactggaagagtggtccatagaccccatgaagacattgtcatgatttgagagactgttgttgaaaggattaacacaatcttaatacactgaaaattttaactgtgtcaagtcagcttagtggagatttagctatgccagtgagcagtgattttaactattcttggctgcttaaacagggcagctatgaactatgacaaatgtagatttttcaaagcaatacaaaatactaaaaaagaggaaccttaatgaatattaaccacacagtctttcttagccattccaaaaagaggcaaagcaattcttattttcttttttaaaataatgattaatatgattttgtgcacttcatactgtcactttttaaaactacagaaaagagatttagagtataacagaaacaagtgtgctttgatagtctcaaataggtagaattcatagttcaagacctgaatccactgtcatctctttcttcctcccattgcagctatcctcaggtaccaaatgttttgatttttaaataaggatagtaataaatggaggaggtgtcctataaatttaaagttcagttgacccagccttatacttaagatagccttatgaaaaatatgtgctgtgaggcagaagtatattttggcagagagaataataaataaaactttttcttttagctcaatatccttactttggtaagtatttttttttatttcacatctacttaacagaaaataaactgagaaatagaagtcagtccattggcataatttatcattcttcactttaaaaaattctaataaatattctgcttgagttttcttttctgctatttgttcttacttgcaactttaagtcaaacctcccaatacaaaacattaaaagctaacattaatgtactaaagtattaatttaaaagaaatcgaacctcccatgctagatttgaaaataacatcatcacagcaccctgatcccaaatattacaccgaggcttttaaaatgtaagtgaaatctagctaagtttcatggtttcattaaaagcaaatgtctgcctctatctgaaaaacaaatggaaatcttttgaggtgttaataccctttggatcctcatcaaaaggatggcattcacctgaggattcctatcttgacttcttaggtattaaaaacctttcttgatatgctctacattttaaaatttgttttataaaatccttatgttgattttcattttattctcaagtacaatacgtttcactctagaccagttgaagaacatgtttaaactttgttcatggtcaaattcattttctatttttttagtaacatatctcttaaaaagcacactaccttataaaaaacttcatcagaaattaaatttaatgcaagtaaattgccatctgatacttccacatgctatcataatcaactgtaataataaaaatgatttatccaattagaaaaggacaagatatatttttctctgtatttctataacttttgccactccattgaatacattgtatgttggacataagattattagtaatgcattcttgagatcttttattttggaatgatgctaactctgtctctttgccaattctaataccaggttccaagtaataactctacagtacaaagagaactgaatattcattctagggctataggatatgaacttcacaattcatttgggtacattctcattgaatttccttcaaaacaatctgttcctggtgcccagtgataattcagtcgggaccagcatgactaaaaggaaggggatatgctaaggctcagcaaagtgaccctaaatgagagatatgtcccaggatggaaagaagaagacgtggtttaaccaagttatactgactaatctaagcagtccactcatccttccattttgggaaaggagtgggggcagcctaagaagaacatatctggattgggaagaaccgtctttctgggctagggatggggaacagaaagggagtatggaaagaaaaattataagagatttgactgaagcaaggaaaaaaagcaaatccccaaacgtgctaatccttgaaagtaactatctttcccaaactactgctgttaccagcaagtgatcaggaagactaggagctatttctgactgtaaatgaattgtataatagctctgctgcagttctgtgacttccaagccaggaattaaatgctctttttaagaataacaaaaaacaaaagcatttcctatgctagtctcccagtaaaatgtacatgttttggagacttcaaaggtattatgtgagttcacatttagcaacagcttattaataaccctcaagctgtcagaatctctatagttaccatttacaattttatactgtgaaaaaatacagatcagtgaaagcataaagacaagtcagaattcactttgaagagggtctgaggcctgggagagtctctactgtctattgaagaatgaggcatgtataaaatagttggttgaatttcactgatcttcccaatgtgaacaaatatactatgtatattgtgtgtatttctagaaatcaatggcagctgctgatggtgttgtaattagaaatctatatagattatagatgttttagaaagatggtgccaatcctaaaagatttgtgtgggctaaaagtgcttgtacttacttttttctgcacttataactgatttggttttaaaattgtgtgcgtgtatctgttctttctctgttgtggcagcttgtactattaaaataatagagaatgttaaattattttgatgtgaactgcaaatgattttttttcataaagtttaacatttttatcagcattgttttgctttgtacttgtataaatatgttttattttagcacttcaaaatatacttgcctgtttctcagttgtctaaatcatgttgtacttggtgtttgtgaagccagttacttttcaaaaaaattaaaaaacctataatatga

SEQ ID NO: 2615 - DNA, 2303 bp, Homo sapiens
catttgggtcgtgccattctcaggggaaccaaccccaatacctaagggaggctgggaggcgtgtcctcaggaccgtagttcttattggtttcgctgctcgctgtggggtgggctggtgcagccgcagctgttgcttattggcccaccgattccatggggaggaacttggctgggcctaaactcaatccgtggtctggtacaggtttcagggcaaagcggccatgcgttccgggggccgcgggcgaccccgcctgcggctgggggaacgtggcctcatggagccactcttgccgccgaagcgccgcctgctaccgcgggttcggctcttgcctctgttgctggcgctggccgtgggctcggcgttctacaccatttggagcggctggcaccgcaggactgaggagctgccgctgggccgggagctgcgggtcccattgatcggaagcctccccgaagcccggctgcggagggtggtgggacaactggatccacagcgtctctggagcacttatctgcgccccctgctggttgtgcgaaccccgggcagcccgggaaatctccaagtcagaaagttcctggaggccacgctgcggtccctgacagcaggttggcacgtggagctggatcccttcacagcctcaacacccctggggccagtggactttggcaatgtggtggccacactggacccaagggctgcccgtcacctcacccttgcctgccattatgactcgaagctcttcccacccggatcgaccccctttgtaggggccacggattcggctgtgccctgtgccctgctgctggagctggcccaagcacttgacctggagctgagcagggccaaaaaacaggcagccccggtgaccctgcaactgctcttcttggatggtgaagaggcgctgaaggagtggggacccaaggactccctttacggttcccggcacctggcccagctcatggagtctatacctcacagccccggccccaccaggatccaggctattgagctctttatgcttcttgatctcctgggagcccccaatcccaccttctacagccacttccctcgcacggtccgctggttccatcggctgaggagcattgagaagcgtctgcaccgtttgaacctgctgcagtctcatccccaggaagtgatgtacttccaacccggggagccctttggctctgtggaagacgaccacatccccttcctccgcagaggggtacccgtgctccatctcatctccacgcccttccctgctgtctggcacacccctgcggacaccgaggtcaatctccacccacccacggtacacaacttgtgccgcattctcgctgtgttcctggctgaatacctggggctctagcgtgcttggccaatgactgtggagaggactgtgagagagaaggtcccagcgggggccagtgaagctcaggcaggatctgcctagggtgtgctggtttgtccttttcatacctttgtctcctaattgtgctacaattggaagaccttctttcttttgattgtctcaagctgccacccttcaaggacagggaagagaccactgtgggatgacagccagaggaataagaacttgctccctccccagaggtaaacacttggtccaaaggtttgcagggaccaaatactgttctttttttttttgagacggagtctcactgtgttgcccaggctggagtgcagtggtgcgatctcggctcactgcaaactccgcctcctgggttcacgccattctcctgcctcagcctcccaagtagctgggactacaggtgcccgccaccacgctggctaattttttgtatttttagtagagacggggtttcaccgtgttagccaggatggtctcgatctcctgaccttgtaatccgccagcctcggcctcccaaagtgctgggattacaggtgtgagccaccgcacctggcaaaatgctgttctttaagtcagcgaactgaaaaagtaaaagactgctgggtgtggtggctcacacctgtaatcccaacactttgagaggctgagggggaaggatcacccgaggtcaggagtttgagaccagcctggtcaacatggcgaaaccctgtctctactaaaaatacaataattagctgggcatggtggtgggcgcctgtaatctcagctgcttgggaggctgaggcaggagaatcacttgtacgcaggaggcggaggttgcagtgagccaagatcacaccactgcactccagcctgggcaacagagcgagactccatctcaataaataaataaataaataaatatttttt

SEQ ID NO: 2616 - DNA, 2021 bp, Homo sapiens
catttgggtcgtgccattctcaggggaaccaaccccaatacctaagggaggctgggaggcgtgtcctcaggaccgtagttcttattggtttcgctgctcgctgtggggtgggctggtgcagccgcagctgttgcttattggcccaccgattccatggggaggaacttggctgggcctaaactcaatccgtggtctggtacaggtttcagggcaaagcggccatgcgttccgggggccgcgggcgaccccgcctgcggctgggggaacgtggcctcatggagccactcttgccgccgaagcgccgcctgctaccgcgggttcggctcttgcctctgttgctggcgctggccgtgggctcggcgttctacaccatttggagcggctggcaccgcaggactgaggagctgccgctgggccgggagctgcgggtcccattgatcggaagcctccccgaagcccggctgcggagggtggtgggacaactggatccacagcgtctctggagcacttatctgcgccccctgctggttgtgcgaaccccgggcagcccgggaaatctccaagtcagaaaggcagccccggtgaccctgcaactgctcttcttggatggtgaagaggcgctgaaggagtggggacccaaggactccctttacggttcccggcacctggcccagctcatggagtctatacctcacagccccggccccaccaggatccaggctattgagctctttatgcttcttgatctcctgggagcccccaatcccaccttctacagccacttccctcgcacggtccgctggttccatcggctgaggagcattgagaagcgtctgcaccgtttgaacctgctgcagtctcatccccaggaagtgatgtacttccaacccggggagccctttggctctgtggaagacgaccacatccccttcctccgcagaggggtacccgtgctccatctcatctccacgcccttccctgctgtctggcacacccctgcggacaccgaggtcaatctccacccacccacggtacacaacttgtgccgcattctcgctgtgttcctggctgaatacctggggctctagcgtgcttggccaatgactgtggagaggactgtgagagagaaggtcccagcgggggccagtgaagctcaggcaggatctgcctagggtgtgctggtttgtccttttcatacctttgtctcctaattgtgctacaattggaagaccttctttcttttgattgtctcaagctgccacccttcaaggacagggaagagaccactgtgggatgacagccagaggaataagaacttgctccctccccagaggtaaacacttggtccaaaggtttgcagggaccaaatactgttctttttttttttgagacggagtctcactgtgttgcccaggctggagtgcagtggtgcgatctcggctcactgcaaactccgcctcctgggttcacgccattctcctgcctcagcctcccaagtagctgggactacaggtgcccgccaccacgctggctaattttttgtatttttagtagagacggggtttcaccgtgttagccaggatggtctcgatctcctgaccttgtaatccgccagcctcggcctcccaaagtgctgggattacaggtgtgagccaccgcacctggcaaaatgctgttctttaagtcagcgaactgaaaaagtaaaagactgctgggtgtggtggctcacacctgtaatcccaacactttgagaggctgagggggaaggatcacccgaggtcaggagtttgagaccagcctggtcaacatggcgaaaccctgtctctactaaaaatacaataattagctgggcatggtggtgggcgcctgtaatctcagctgcttgggaggctgaggcaggagaatcacttgtacgcaggaggcggaggttgcagtgagccaagatcacaccactgcactccagcctgggcaacagagcgagactccatctcaataaataaataaataaataaatatttttt

SEQ ID NO: 2617 - DNA, 2158 bp, Homo sapiens
actagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggtaactttttcctttcattactttacagaaatactgtcaagtccaatagagagcacagacttgggaggcggattgggtgggtttgaatctctgctctgccacttttattaatcatgtgagttgagtatgtgacttaatctcttttagctcaatttccccatctgtaaaataggaataataaaaatactgacttcagagaggtttgtgaggatcaattagacagtcatgttaagtctgtaaattgtttctgtaatgggcaagatagcaaatattttagattttgtggaccatgcagtctttatcataactgcttaactgccattatagtgagaaagcagccacagacaatatgtaaatgaaaaagtgtgtctctgttccaataaaactttattttcaaaaaccagctggcttgtcacatctggcctatgggccatagtttgcccatccctaatgtaaagaaaggactttagcccaaagccacaacttgcatagtaatgcctcaaaaaatgttaacatctttactgttattattattactactgcatctattacagtagcaattgagtaatgaatacatgaatgttataatgttaaattactaaccttttaaaaatattaagcattgcaatatattaatactttaaatcttttaggaagataagttaccctgcagaataatgaagtttcacaacctcagcactgttggtgtttggggctggtaattgtttgttgtgggagactgtcctgtgcattgtaagatgtttagtagcatccctggcctctacccctacatgcaagtagtaccccaccaccaaaaccacaatcccacaaccaaaaatgtctgcagacattgtcaagtgtctcctggttagggaaaaggagacaaaagtaacccccaggtaagaccactgctatagagaaatactaccttatttaaaatcttccattaaggtaatatatgtaaggccaggtgcgtacacctgtaatcccagcaccttgggaagccaaggcaggaggatcgcttgagatcaggagtttgagaccagcctgggcaacatacagagccctatgtctacaaaaagttttaaaaaaattgtggggtgtggtggtgtgcacctgtggtcctagctgtttgggaggctgaggggggaggattgcttgagtccaggaggttgagactgccgtgagccatgattgcaccactgcactccaccctaggtgacagagcaagaccctatctc

SEQ ID NO: 2618 - DNA, 4106 bp, Homo sapiens
agtgacaattaaagatggctgcgcccatgtaacatcactagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacagaa

SEQ ID NO: 2619 - DNA, 2081 bp, Homo sapiens
ggcgttacgcgcgggcgcactgcgggggccaaggaaggaagaaatgtggtcgcggttggtgtggctgggccttcgggcccctctgggcgggcgccagggcttcacctccaaggcggatcctcagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacagatgtctatacctgagatccgacaatgtggtagaaggcaactgtgctgatgaattactacaaaactcccatcgcgtcgtggaggagtactttgtggcccccccaggtaatatctctttgccaaagctggatgaacaagagccattcccacacagctgagtagctcattctggaaagggggtactctgtgaacatgtggaagcataatgacagtatttttttactgtgaatactaatgttcctgcttttttcagtcccctgaaaaaatggatgctcaagcatttcttaataacagattcttctgaagacagaattgggaaagatctggccccaacaaggcagtgagttcctgatgctaactgaggtgaaagaaaagcaaaagtcagcttccaaggaattcacttaacaggcctgttcagtatggaagacattatttatctgcctttaactccccccaaaggaccataccaactgcatgaaagtgaacttttctatctacgtaactggtagacggagcatcttgatcactatgtgacaaccttggctgtcatttttagttgccatttgcattgatttgagcagccctatctttaccgaacatacctgaatttgttcctgggctcccactttcttcccagaagagggctaacttcctactaaggtctgaagagtgttgaaagtagactagagcttgggaactcctaacctagaactatctgccatcccacaaagtgattatatgccaaagggatactagtcatacctagtgtttctctttctgaaaagagaacttatcctaaaattagccctgggcctgggacaaaggagccctctccgcccccaaaatgattattaaattgagatgagtccaggataaaactcagataccaaggataaatgaaacttatttagggataaaagtgggctgggcgcagtggctcactcctgtaatcccagcactttgggaggctgagacgggcggatcacaaggtcaggagatcaagaccatcctggctaatgcggtgaaacctcatctctactaaaaatacaaaaaattagctgggtgtgatgacaggtgcctgtagtcccagctactcgggaggctgaggcaggagaatggcgtgaacccgggagacggagcttgcagtaagccgagatcgcaccactgcactccagcctgggcgacagagcaagtctcaaaaaaaaaaaaaaagtgatagaatcagagagtttttcctctaaccaaactgccaaagttggttttggctaagaatttcccaataatatttatgctgctgctcatttttttagttttctgagacaggggtctccctctgtcacccaggctggagtgcagtggtgacagatcactgcagcctccaactcctgggctcaagtgatcctcccacctcagcctcctaagtaactgggactacatatgtgcatcaccacgtccagttaatttttttttaagtagaggtgggggttttgctatgttgcctatctggtcgtgaactcctggcctcaagggatcctctggcatgccttggcctcccaaagggctaggatcacaggcaaaagccaccgtgtgtttatttttcccattcccttcctttatctgcaatgcttttttctttaaggcagcctaatttacaagcttggccttgaattaaaagagaacccagaacccgctcttggagtttacgttctcaaaccaacatcagagcaactgtctatccccatataaataaagttatctacccctgctcctaactgggtacaagtt

SEQ ID NO: 2620 - DNA, 1411 bp, Homo sapiens
aaactaagccggtttcaagtttcagctcctccttgaattccaggctgctgagacttccctctagaatcctccaacatggagcctcttgcagcttacccgctaaaatgttccgggcccagagcaaaggtatttgcagttttgctgtctatagttctatgcacagtaacgctatttcttctacaactaaaattcctcaaacctaaaatcaacagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctgcatttagatttcttgttgattcttcaaagaaggaaccaaggtggaatttttggaagtatcttgtcaaccctgagggtcaagttgtgaagttctggaagccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactctgtcacccaggctggagtgcagtagtgcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttctggaataactgtaaatggttatgttaatggaataaaacacaaatgttgaaaaatgtaaaatatatatacatagattcaaatccttatatatgtatgcttgttttgtgtacaggattttgttttttctttttaagtacaggttcctagtgttttactataactgtcactatgtatgtaactgacatatataaatagtcatttataaatgaccgtattataacatttgaaaaagtcttcatcattttcagta

SEQ ID NO: 2621 - DNA, 2761 bp, Homo sapiens
agtccacgccttgtggcggctttgcggagctgctgctttggcgggagttggaagctggtgtgaggtgagaggcgcggtggtcgctccccggcgaggccaggtttctgtggggagaaggagagtgccagaggtgactggttcatggttcttctaggctctcatggccaccatgttggaaggcagatgccaaactcagccaaggagcagccccagtggccgagaggctagcctgtggtcgtcaggctttgggatgaagctggaggctgtcactccattcctggggaagtatcgcccctttgtgggtcgctgttgccagacctgcacccccaagagctgggagtccctcttccacagaagcataacggacctaggcttctgcaatgtgatcctggtgaaggaggagaacacaaggtttcggggctggctggttcggaggctctgctatttcctgtggtccctggagcagcacatccccccctgccaggatgtcccacagaagatcatggaaagcaccggggtgcagaacctcctctcagggagggtcccaggaggcactggggaaggccaggtgcctgaccttgtgaagaaggaggtacagcgcatcctgggtcacatccaggccccaccccgtcccttcctggtcaggctgttcagctgggcgctgctgaggttcctgaactgcctgttcctgaatgtgcagctccacaagggtcagatgaagatggtccagaaggccgcccaggcaggcttgccgcttgtcctcctctctactcacaaaaccctcctggatgggatcctgctgccctttatgctgctctcccagggcctgggtgtgcttcgtgtggcctgggactcccgcgcctgctcccctgccctcagagctctgctgaggaagcttggggggcttttcctgcccccagaggccagcctctccctggacagctctgaggggctccttgccagggctgtggtccaggcggtcatagagcagctgctggttagtgggcagcccctgctcatcttcctggaggaacctcctggggctctggggccacggctgtcagccctgggccaggcttgggtggggtttgtggtgcaggcagtccaggtgggcatcgtcccagatgctctgctggtaccagtggccgtcacctatgacctggttccggatgcaccgtgtgacatagaccatgcctcggcccccctggggctgtggacaggagctctggctgtcctacgtagcttgtggagccgctggggctgcagccaccggatctgctcccgggtgcacctagctcagcccttttccctgcaggaatacatcgtcagtgccagaagctgctggggcggcagacagaccctggagcagctactgcagcccatcgtgctgggccaatgtactgctgtcccagacactgagaaggagcaggagtggacccccataactgggcctctcctggccctcaaggaagaggaccagctcctggtcaggagactgagctgtcatgtcctgagtgccagtgtagggagctctgcggtgatgagcacggccattatggcaacgctgctgctcttcaagcatcagaagctcctgggggagttctcctggctgacggaggagatactgttgcgtggctttgatgtaggcttctctgggcagctgcggagcctgctgcagcactcactgagcctgctgcgggcgcacgtggccctgctgcgcatccgtcagggtgacttgctggtggtgccgcagcctggcccaggcctcacacacctggcacaactgagtgctgagctgctgcccgtcttcctgagcgaggctgtgggcgcctgtgcagtgcgggggctgctggcaggcagagtgccgccccaggggccctgggagctgcagggcatattgctgctgagccagaatgagctgtaccgccagatcctgctgctgatgcacctgctgccgcaagacctgctgctgctaaagccctgccagtcttcctactgctactgtcaggaggtgctggaccggctcatccaatgcgggctcctggttgctgaggagaccccaggctcccggccagcctgtgacacagggcgacagcgattgagcagaaagctgctgtggaaaccgagtggggactttactgatagtgacagtgatgacttcggagaggctgacggccggtacttcaggctcagccagcagtcacactgcccagatttctttcttttcctctgccgcctgctcagcccgctgctcaaggcctttgcacaggctgccgccttcctccgccagggccagctgcccgatactgagttgggctacacagagcagctgttccagttcctgcaggccaccgcccaggaagaagggatcttcgagtgtgcggacccaaagctcgccatcagtgctgtctggaccttcagagacctaggggttctgcagcagacgccgagccctgcaggccccaggctccacctgtcccctacttttgccagcctggacaatcaggaaaaactagaacagttcatccggcagttcatttgtagctagaactgtgaggaggagcctgtgctgagacttctcagccccagaacacagctgtgtcctagagccagaagatggagaggaggctgcaaacccttagctgctctataaatataatcattgaggcttgattgtcccttgccatctcttgctttttcccttctttgatgtgataaacaaggggacgagacgagttgtcttttccccagcccagcagca

SEQ ID NO: 2622 - DNA, 2507 bp, Homo sapiens
agtccacgccttgtggcggctttgcggagctgctgctttggcgggagttggaagctggtgtgaggtgagaggcgcggtggtcgctccccggcgaggccaggtttctgtggggagaaggagagtgccagaggtgactggttcatggttcttctaggctctcatggccaccatgttggaaggcagatgccaaactcagccaaggagcagccccagtggccgagaggctagcctgtggtcgtcaggctttgggatgaagctggaggctgtcactccattcctggggaagtatcgcccctttgtgggtcgctgttgccagacctgcacccccaagagctgggagtccctcttccacagaagcataacggacctaggcttctgcaatgtgatcctggtgaaggaggagaacacaaggtttcggggctggctggttcggaggctctgctatttcctgtggtccctggagcagcacatccccccctgccaggatgtcccacagaagatcatggaaagcaccggggtgcagaacctcctctcagggagggtcccaggaggcactggggaaggccaggtgcctgaccttgtgaagaaggaggtacagcgcatcctgggtcacatccaggccccaccccgtcccttcctggtcaggctgttcagctgggcgctgctgaggttcctgaactgcctgttcctgaatgtgcagctccacaagggtcagatgaagatggtccagaaggccgcccaggcaggcttgccgcttgtcctcctctctactcacaaaaccctcctggatgggatcctgctgccctttatgctgctctcccagggcctgggtgtgcttcgtgtggcctgggactcccgcgcctgctcccctgccctcagagctctgctgaggaagcttggggggcttttcctgcccccagaggccagcctctccctggacagctctgaggggctccttgccagggctgtggtccaggcggtcatagagcagctgctggttagtgggcagcccctgctcatcttcctggaggaacctcctggggctctggggccacggctgtcagccctgggccaggcttgggtggggtttgtggtgcaggcagtccaggtgggcatcgtcccagatgctctgctggtaccagtggccgtcacctatgacctggttccggatgcaccgtgtgacatagaccatgcctcggcccccctggggctgtggacaggagctctggctgtcctacgtagcttgtggagccgctggggctgcagccaccggatctgctcccgggtgcacctagctcagcccttttccctgcaggaatacatcgtcagtgccagaagctgctggggcggcagacagaccctggagcagctactgcagcccatcgtgctgggccaatgtactgctgtcccagacactgagaaggagcaggagtggacccccataactgggcctctcctggccctcaaggaagaggaccagctcctggtcaggagactgagctgtcatgtcctgagtgccagtgtagggagctctgcggtgatgagcacggccattatggcaacgctgctgctcttcaagcatcagaagctcctgggggagttctcctggctgacggaggagatactgttgcgtggctttgatgtaggcttctctgggcagctgcggagcctgctgcagcactcactgagcctgctgcgggcgcacgtggccctgctgcgcatccgtcagggtgacttgctggtggtgccgcagcctggcccaggcctcacacacctggcacaactgagtgctgagctgctgcccgtcttcctgagcgaggctgtgggcgcctgtgcagtgcgggggctgctggcaggcagagtgccgccccaggggccctgggagctgcagggcatattgctgctgagccagaatgagctgtaccgccagatcctgctgctgatgcacctgctgccgcaagacctgctgctgctaaagccctgccagtcttcctactgctactgtcaggaggtgctggaccggctcatccaatgcgggctcctggttgctgaggagagttgggctacacagagcagctgttccagttcctgcaggccaccgcccaggaagaagggatcttcgagtgtgcggacccaaagctcgccatcagtgctgtctggaccttcagagacctaggggttctgcagcagacgccgagccctgcaggccccaggctccacctgtcccctacttttgccagcctggacaatcaggaaaaactagaacagttcatccggcagttcatttgtagctagaactgtgaggaggagcctgtgctgagacttctcagccccagaacacagctgtgtcctagagccagaagatggagaggaggctgcaaacccttagctgctctataaatataatcattgaggcttgattgtcccttgccatctcttgctttttcccttctttgatgtgataaacaaggggacgagacgagttgtcttttccccagcccagcagc

SEQ ID NO: 2623 - DNA, 3061 bp, Homo sapiens
gtttttcagcgtcagagtctcaggatctcgatgtggacaggcaccctgatacaaaagaacgctcagaattttgctagagccgaaccccagcttggaggagcgtaagccctgggataacttctttaatcagaatctggcctgagtccctgctcgaagctcaagcacccggggcctcgcggccgcctgcagtactcccctcccaccgcgggccagggccgactggaaaacggagcaggccatccccagagcacgggtcccgtggccacgttgagtgtcgcagagtacgggacgcagggcggggcttctggaccagcgcgcatcccaattggctctcggggctgccttttagccggacgcgcggaggtgggcaatccgctccttcccttgagcagtccacgccttgtggcggctttgcggagctgctgctttggcgggagttggaagctggtgtgaggctctcatggccaccatgttggaaggcagatgccaaactcagccaaggagcagccccagtggccgagaggctagcctgtggtcgtcaggctttgggatgaagctggaggctgtcactccattcctggggaagtatcgcccctttgtgggtcgctgttgccagacctgcacccccaagagctgggagtccctcttccacagaagcataacggacctaggcttctgcaatgtgatcctggtgaaggaggagaacacaaggtttcggggctggctggttcggaggctctgctatttcctgtggtccctggagcagcacatccccccctgccaggatgtcccacagaagatcatggaaagcaccggggtgcagaacctcctctcagggagggtcccaggaggcactggggaaggccaggtgcctgaccttgtgaagaaggaggtacagcgcatcctgggtcacatccaggccccaccccgtcccttcctggtcaggctgttcagctgggcgctgctgaggttcctgaactgcctgttcctgaatgtgcagctccacaagggtcagatgaagatggtccagaaggccgcccaggcaggcttgccgcttgtcctcctctctactcacaaaaccctcctggatgggatcctgctgccctttatgctgctctcccagggcctgggtgtgcttcgtgtggcctgggactcccgcgcctgctcccctgccctcagagctctgctgaggaagcttggggggcttttcctgcccccagaggccagcctctccctggacagctctgaggggctccttgccagggctgtggtccaggcggtcatagagcagctgctggttagtgggcagcccctgctcatcttcctggaggaacctcctggggctctggggccacggctgtcagccctgggccaggcttgggtggggtttgtggtgcaggcagtccaggtgggcatcgtcccagatgctctgctggtaccagtggccgtcacctatgacctggttccggatgcaccgtgtgacatagaccatgcctcggcccccctggggctgtggacaggagctctggctgtcctacgtagcttgtggagccgctggggctgcagccaccggatctgctcccgggtgcacctagctcagcccttttccctgcaggaatacatcgtcagtgccagaagctgctggggcggcagacagaccctggagcagctactgcagcccatcgtgctgggccaatgtactgctgtcccagacactgagaaggagcaggagtggacccccataactgggcctctcctggccctcaaggaagaggaccagctcctggtcaggagactgagctgtcatgtcctgagtgccagtgtagggagctctgcggtgatgagcacggccattatggcaacgctgctgctcttcaagcatcagaagctcctgggggagttctcctggctgacggaggagatactgttgcgtggctttgatgtaggcttctctgggcagctgcggagcctgctgcagcactcactgagcctgctgcgggcgcacgtggccctgctgcgcatccgtcagggtgacttgctggtggtgccgcagcctggcccaggcctcacacacctggcacaactgagtgctgagctgctgcccgtcttcctgagcgaggctgtgggcgcctgtgcagtgcgggggctgctggcaggcagagtgccgccccaggggccctgggagctgcagggcatattgctgctgagccagaatgagctgtaccgccagatcctgctgctgatgcacctgctgccgcaagacctgctgctgctaaagccctgccagtcttcctactgctactgtcaggaggtgctggaccggctcatccaatgcgggctcctggttgctgaggagaccccaggctcccggccagcctgtgacacagggcgacagcgattgagcagaaagctgctgtggaaaccgagtggggactttactgatagtgacagtgatgacttcggagaggctgacggccggtacttcaggctcagccagcagtcacactgcccagatttctttcttttcctctgccgcctgctcagcccgctgctcaaggcctttgcacaggctgccgccttcctccgccagggccagctgcccgatactgagttgggctacacagagcagctgttccagttcctgcaggccaccgcccaggaagaagggatcttcgagtgtgcggacccaaagctcgccatcagtgctgtctggaccttcagagacctaggggttctgcagcagacgccgagccctgcaggccccaggctccacctgtcccctacttttgccagcctggacaatcaggaaaaactagaacagttcatccggcagttcatttgtagctagaactgtgaggaggagcctgtgctgagacttctcagccccagaacacagctgtgtcctagagccagaagatggagaggaggctgcaaacccttagctgctctataaatataatcattgaggcttgattgtcccttgccatctcttgctttttcccttctttgatgtgataaacaaggggacgagacgagttgtcttttccccagcccagcagca

SEQ ID NO: 2624 - DNA, 588 bp, Homo sapiens
gcagtccacgccttgtggcggctttgcggagctgctgctttggcgggagttggaagctggtgtgaggtgagaggcgcggtggtcgctccccggcgaggccaggctctcatggccaccatgttggaaggcagatgccaaactcagccaaggagcagccccagtggccgagaggctagcctgtggtcgtcaggctttgggatgaagctggaggctgtcactccattcctggggaagtatcgcccctttgtgggtcgctgttgccagacctgcacccccaagagctgggagtccctcttccacagaagcataacggacctaggcttctgcaatgtgatcctggtgaaggaggagaacacaaggtttcggggctggctggttcggaggctctgctatttcctgtggtccctggagcagcacatccccccctgccaggatgtcccacagaagatcatggaaagcaccggggtgcagaacctcctctcagggagggtcccaggaggcactggggaaggccaggtgcctgaccttgtgaagaaggaggtacagcgcatcctgggtcacatccaggccccaccccgtcccttcctg

SEQ ID NO: 2625 - DNA, 6369 bp, Homo sapiens
gccactgcagctggcattggccgggactggaagtgcgggcttctgcagcagccgaagctggagctgctagggcagcagcggctcccctgttgtatggacattctgcacccgaaactgatagctgagtcctgaagttttatgttatgaaacagaagaactttcatcccagcacatgatttgggaattacactttgtgacatggatgaatctgcactgacccttggtacaatagatgtttcttatctgccacattcatcagaatacagtgttggtcgatgtaagcacacaagtgaggaatggggtgagtgtggctttagacccaccatcttcagatctgcaactttaaaatggaaagaaagcctaatgagtcggaaaaggccatttgttggaagatgttgttactcctgcactccccagagctgggacaaatttttcaaccccagtatcccgtctttgggtttgcggaatgttatttatatcaatgaaactcacacaagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatgatcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgaaggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaaggcaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttccagaacctttgtcttggagaagtgatgaagaagatgaagacagtgactttggggaggaacagcgagattgctacctgaaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatgctgagagtgccacatattgtcttgtgaagaatgctgtgaaaatgtttaaggatattggggttttcaaggagaccaaacaaaagagagtgtctgttttagaactgagcagcacttttctacctcaatgcaaccgacaaaaacttctagaatatattctgagttttgtggtgctgtaggtaacgtgtggcactgctggcaaatgaaggtcatgagatgagttccttgtaggtaccagcttctggctcaagagttgaaggtgccatcgcagggtcaggcctgccctgtcccgaagtgatctcctggaagacaagtgccttctccctccatggatctgtgatcttcccagctctgcatcaacacagcagcctgcagataacacttggggggacctcagcctctattcgcaactcataatccgtagactacaagatgaaatctcaataaattatttttgagtttattaaagattgacattttaagtacaacttttaaggactaattactgtgatggacacagaaatgtagctgtgttctggaactgaatcttacatggtatacttagtgctgctgggtaatttgttggtatattatctggttagtggttaatgcttcctttaaaaataattgagtcatccattcactctttttcagttttatctgtcaatagtagctacatttttaatgggagcaccttttatcccaaagtgctttataaattgagtggactgatatatatcacacccaggtatcactgtgctgtcctttgctgtcagatttagaaatgtttttaagagctatgtgaaaacagacaatattagtttaggtcgggaactgagatattgtaatcaaatagttaacatcaggaagttaatttggctggcaaaattctagggaaacttggccagaaaactggtgttgaaggcttttgctcatataaacaagtgccattgagtttcaaatgaccagcaaatatatttagaacccttcctgttttatgtctgtacctcgtccacccctcaggtaatacctgcctctcacaggtacagctgtttcttggaaatcctccaaccaaatagcagttttcctaacttgattagcttgagctgacagactgttagaatacagttctctggccacagctgatgagggctttctgtactgcacacagattgtgtactgcaccccagtccaggtgactggtacccactcgagttgtgccgtgcacaacctgtccagtatatgcatgtggtggccctactgactggtaatggttagaggcatttatggatttttagctttgaggaaaaaccatgacttttaacaaatttttatgggttatatgcctaaacccttatgccacatagtggtaaataattatgaaaaatggtctgttcataattggtaggtgccttttgtgagcagggagcataattattggtttattatggtaattatggtgattttttaaatatcatgtaatgttaaaacgttttctaacagtttactgttgcttatctccaagatattatggaattaagaatttttccagatgagtgttacatagattctttgaatttagtataaaagtactgagaattaagtttgtacttccataagcttggattttaaacactgatagtatctcatgagtaatgtgtgttttgggagagggagggatgctgattgatatttcacattgtatgaaataccatgtttgaaactcatagcaataatgctatgctgttgtgatccctctcaagttctgcatttaaaatatattttttctttataggaattgatgtataccatgaagtcattgtcagttgtagtagctctgatgttgaatgagatatcatgttttagcattccattttactgactagggtagaagaacacttttcttggctacatttggaggatacccagggagtcttgggtgttccttatctggggaagcaaacatttcactagtctctttttttcatcctttaaattgtaaattaaggattactcaagctcaccattattcaagattgggactcgcttcccagtcgacactctgccctgcctgtcattgctgcaaagagctgctgctttgccaacctaagcaaagaaaatacggcttctcttgcattattttcccttttggttggtttgttttctagaagtacgttcagatgctttggggaatgcaatgtatgatttgctagctctctcaccacttaactcactgtgaggataaatatgcatgctttttgtaattaactggtgctttgaaaatcttttttaagggagaaaaatctcaaccaaagttatgctcatccagacaagctgacctttgagttaatttcagcacaactcattcttcagtgcctcatgactgaaaacaaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagttaaaaaaaaaaaacaatattaaacaacatgaaactgcagtctgtttttgaaaatgagaatgtcctaagtgattcagaagagaggagggaagttgtgcactctgaaaatgcatgaaaaacaaaggcaaaaactagtgggaaatgtgtagaactgttaactgagatggcttcgagtcttccttctggaatctgttaaatttcacaaagtcatgagggtaaatggagaaaatatttctgggattacaatgaatgtaagcccaaattgtggaattgccagtaacctggatggggaaaagcatttcccatagcactccatgtaatatgagtgctctgtgagatgttcatcagtgttttatagaaatggtgttgctgggaaaccaagtttgcacctggaaacttacaatgcactttagcgcagtaagggcttggcatccggtagtgaaaaactgtctaacccagcattgcccaaactattttgacaccaggacctttttctcctttgggatacttatgaacctctcactaatgtcctgtggagaacattttgggaaacactatgttagatagttctttaaggagacaaaacggtaatgaacagatagcactggggcagaatatgcatgcattttgtaacgtccagtgtggcgttgaatagatgtgtatttcctcccctgcagaaaataagcacagaaaattataatgtaggtgatcggagctctttcctttgatagagagaacagccccaatgatcctggctttttcactgaacgtatcagaatacatggatgaattggggtaaataaggttttaattcagatctagaagaaagtattgtacgtttgaatgcagatttttatccacagatagttgtagtgtttagacatgacaggacctatcgttgaggtttctaagacttactatgggctgtaaacctgttttttaaaactattttagaaacctgagacttgccgtctggcattttagtttaatacaaactaatgattgcatttgaaagagattcttgaccttatttctaaacgtctagagctctgaaatgtcttgatggaaggtattaaactatttgcctgttgtacaaagaaatgttaagactcgtgaaaagaattactataaggtactgtgaaataactgcgattttgtgagcaaaacatacttggaaatgctgattgatttttatgcttgttagtgtattgcaagaaacacagaaaatgtagttttgttttaataaaccaaaaattgaacat

SEQ ID NO: 2626 - DNA, 5664 bp, Homo sapiens
gaagctggagctgctagggtgcgaactgccagggcaggcagcagcggctcccctgttgtatggacattctgcacccgaaactgatagctgagtcctgaagttttatgttatgaaacagaagaactttcatcccagcacatgatttgggaattacactttgtgacatggatgaatctgcactgacccttggtacaatagatgtttcttatctgccacattcatcagaatacagtgttggtcgatgtaagcacacaagtgaggaatggggtgagtgtggctttagacccaccatcttcagatctgcaactttaaaatggaaagaaagcctaatgagtcggaaaaggccatttgttggaagatgttgttactcctgcactccccagagctgggacaaatttttcaaccccagtatcccgtctttgggtttgcggaatgttatttatatcaatgaaactcacacaagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatgatcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgaaggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaaggcaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttccagaacctttgtcttggagaagtgatgaagaagatgaagacagtgactttggggaggaacagcgagattgctacctgaaggtacttgggtgaagaattctggtggatattacagggatatgttgaggtttatgctgcagtgagatcagctggagtcctggtgatgtcttcttatctaaagaatcccccaactagctctggtaccttctgtgtggtaaagacactcaaactgtttgagttgaattaatagcattttaagtagaaaaggaaaggagagtctgaaaagtcaggaagatgaatgtcataggtgagactttcaccatccttttatgaaatacacaggtgcatacctgtttacctacacctgcacccctcatgaggcagcagttttgctattgagctgccactgacctggctgctctttttgagtcactcttgctgtccctcccaaaatttcatatattaagctctttgctgtcaattaaaacaaataccattataggagaaaattgagattaaaaaaaaagtccctgatttagaaaaatcaattttgtctaatttataattttagaacttagtaataatgacccgtcttttctgaatactctaagaggattactcttttttgacatttagaaattgtcttctttttcacttgggtggtattagtttagtttcaagatggggcagtgatcttgctttcacactccagaggggcttgaccgaaccagtgtgttttgggtaggtacagtgagagcctctcggccataaagcaccgccgtcacagtggccatcattccccacagtgctggactgtgggcaaaggccatttaggggaggcagggaataggtgctgcagaaggagtgagataatcttggtggtctcccattggtctttctgcagacttgagtgactgttgagcccaggcttcaaaccatggagggcctggtcttaggagcggctatttttagtgatgacagcgtatcacaagtagggcattcatttatgaaaatttcttctaggtggctgttcaatgaacacaagcctcaaataccataaaaaagtgaatgattacaataaagaatgtgtttgaaagccagcagttgtttccagcagagattctctgcatgaggggcagggggccgctttcatgtagtgctgatgtgagtggccatcttctcacgttactggctctccagagaaagtcctctgtccacttgccttgtgtctcttgtcccttcctcatgacttcatctcctgcttttgcacactcaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatggtatgttaagtcactatttattcttttaaaatcttttttttttttttggatttcagaaatttgctaattgtagaaaattggaaaaatgcaaacttatcctgacctctaacaccgtagagtattactattatcttctttggcatgttatataagttgaatgatacagttatacactcttacatctggcttttttcacgtaacgttatttttgagattcatacatgttgcatatagttgttcctttgttcttgttgtgtagtgttccattgtataaatatttaccacattttattcattctgctgttgatggatatttgggttgttttcagttcacagctgctttgaacagtgttgctatgagcatatttgaatatgtcttttggtgaatatctgtgcccctatatacagcatgtatgtgggaacagaattgcctggttgtaggctctgggtatattcggctttggtagataccaccaaacagtttccaagggattatacctacttgtactcccacaacagtgtgtgtttcacttgctgcacatcttggccagcgctccgtcttctttgttttaggaggtgtgattggggtgggagtactattttatacagttgtagtttggagctgaaactacttgaatcactttttagagccaaaaggaatctaatctaatcacctcattttatagttgaggaaaataccccaggtcacactgctaattaatgggtaatctcgggatcagaattcttgtttcctaacctcgaggcctgtgctttctctggttccactgatgtacaatcatctgtgtaccactgggtagcttaaagaatatttatacactatctcatttgattctcacaacagtcctggaaaatggatgttttaggtatttctacttccctctgttctccctatttctctctctacaccctcttttctttccccttccctttcttatttacctcaatataggacaaagtaggtgtaagcaaagtaggtttaacagcaagtcatctgagaactcacaggttgccagtggtggaagtggggccccacccttgtctgctgacttgccctcattctcttcctagctccccatactttcttactgtggctgctgggattgtcatgatttgttgagcgtaaccatttgacagggttttattctctctcttcagctgagagtgccacatattgtcttgtgaagaatgctgtgaaaatgtttaaggatattggggtaggtgtccaccatttatggtataaaagctatctcaacttctgttctctttagatctagtctgtttgagctacctttgtggtggggtggaccccgagagaagcagtttctgctggcttaatgataaaggcatttttgggaacggggcatgtaggatgggttgggctatgttgaaggtgaagcccatcagtgtagatttatttgaatgttctggaattttactggtttcacatttattcccaagctgctatatataactggtatcaatatgtttcaaggtgctacaggttgaatatcccttatccaaaatgttgggaccagaaatgttttggatttcagatttttttgggattttggaatatgtgcattagacttacaggttgagcgtctctaatccaaaacccaaaatgctctgatgagcatgtcttttgagcatcatattgatgttcaaaatctttcagattttggagtacttcagatttttgattttgggattaggaccacaatcttggctcttaattattccatatgatttttagttactttcttgtatttttacaagaatttctagaagtatcctcaggtgtcctttaccttcatgattcatggggaatgtaagttctatagagatactagcggccttttgtgagggactgtttgtgactttattctaagtcattttagagtatagttatgttggttgaaattttagaatatagttaatgttggttgaactccatcaaaacaaaaaaaaaaaaa

SEQ ID NO: 2627 - DNA, 6356 bp, Homo sapiens
gtgcgccactgcagctggcattggccgggactggaagtgcgggcttctgcagcagccgaagctggagctgctaggcagcggctcccctgttgtatggacattctgcacccgaaactgatagctgagtcctgaagttttatgttatgaaacagaagaactttcatcccagcacatgatttgggaattacactttgtgacatggatgaatctgcactgacccttggtacaatagatgtttcttatctgccacattcatcagaatacagtgttggtcgatgtaagcacacaagtgaggaatggggtgagtgtggctttagacccaccatcttcagatctgcaactttaaaatggaaagaaagcctaatgagtcggaaaaggccatttgttggaagatgttgttactcctgcactccccagagctgggacaaatttttcaaccccagtatcccgtctttgggtttgcggaatgttatttatatcaatgaaactcacacaagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatgatcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgaaggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaaggcaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttccagaacctttgtcttggagaagtgatgaagaagatgaagacagtgactttggggaggaacagcgagattgctacctgaaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatgctgagagtgccacatattgtcttgtgaagaatgctgtgaaaatgtttaaggatattggggttttcaaggagaccaaacaaaagagagtgtctgttttagaactgagcagcacttttctacctcaatgcaaccgacaaaaacttctagaatatattctgagttttgtggtgctgtaggtaacgtgtggcactgctggcaaatgaaggtcatgagatgagttccttgtaggtaccagcttctggctcaagagttgaaggtgccatcgcagggtcaggcctgccctgtcccgaagtgatctcctggaagacaagtgccttctccctccatggatctgtgatcttcccagctctgcatcaacacagcagcctgcagataacacttggggggacctcagcctctattcgcaactcataatccgtagactacaagatgaaatctcaataaattatttttgagtttattaaagattgacattttaagtacaacttttaaggactaattactgtgatggacacagaaatgtagctgtgttctggaactgaatcttacatggtatacttagtgctgctgggtaatttgttggtatattatctggttagtggttaatgcttcctttaaaaataattgagtcatccattcactctttttcagttttatctgtcaatagtagctacatttttaatgggagcaccttttatcccaaagtgctttataaattgagtggactgatatatatcacacccaggtatcactgtgctgtcctttgctgtcagatttagaaatgtttttaagagctatgtgaaaacagacaatattagtttaggtcgggaactgagatattgtaatcaaatagttaacatcaggaagttaatttggctggcaaaattctagggaaacttggccagaaaactggtgttgaaggcttttgctcatataaacaagtgccattgagtttcaaatgaccagcaaatatatttagaacccttcctgttttatgtctgtacctcgtccacccctcaggtaatacctgcctctcacaggtacagctgtttcttggaaatcctccaaccaaatagcagttttcctaacttgattagcttgagctgacagactgttagaatacagttctctggccacagctgatgagggctttctgtactgcacacagattgtgtactgcaccccagtccaggtgactggtacccactcgagttgtgccgtgcacaacctgtccagtatatgcatgtggtggccctactgactggtaatggttagaggcatttatggatttttagctttgaggaaaaaccatgacttttaacaaatttttatgggttatatgcctaaacccttatgccacatagtggtaaataattatgaaaaatggtctgttcataattggtaggtgccttttgtgagcagggagcataattattggtttattatggtaattatggtgattttttaaatatcatgtaatgttaaaacgttttctaacagtttactgttgcttatctccaagatattatggaattaagaatttttccagatgagtgttacatagattctttgaatttagtataaaagtactgagaattaagtttgtacttccataagcttggattttaaacactgatagtatctcatgagtaatgtgtgttttgggagagggagggatgctgattgatatttcacattgtatgaaataccatgtttgaaactcatagcaataatgctatgctgttgtgatccctctcaagttctgcatttaaaatatattttttctttataggaattgatgtataccatgaagtcattgtcagttgtagtagctctgatgttgaatgagatatcatgttttagcattccattttactgactagggtagaagaacacttttcttggctacatttggaggatacccagggagtcttgggtgttccttatctggggaagcaaacatttcactagtctctttttttcatcctttaaattgtaaattaaggattactcaagctcaccattattcaagattgggactcgcttcccagtcgacactctgccctgcctgtcattgctgcaaagagctgctgctttgccaacctaagcaaagaaaatacggcttctcttgcattattttcccttttggttggtttgttttctagaagtacgttcagatgctttggggaatgcaatgtatgatttgctagctctctcaccacttaactcactgtgaggataaatatgcatgctttttgtaattaactggtgctttgaaaatcttttttaagggagaaaaatctcaaccaaagttatgctcatccagacaagctgacctttgagttaatttcagcacaactcattcttcagtgcctcatgactgaaaacaaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagttaaaaaaaaaaaacaatattaaacaacatgaaactgcagtctgtttttgaaaatgagaatgtcctaagtgattcagaagagaggagggaagttgtgcactctgaaaatgcatgaaaaacaaaggcaaaaactagtgggaaatgtgtagaactgttaactgagatggcttcgagtcttccttctggaatctgttaaatttcacaaagtcatgagggtaaatggagaaaatatttctgggattacaatgaatgtaagcccaaattgtggaattgccagtaacctggatggggaaaagcatttcccatagcactccatgtaatatgagtgctctgtgagatgttcatcagtgttttatagaaatggtgttgctgggaaaccaagtttgcacctggaaacttacaatgcactttagcgcagtaagggcttggcatccggtagtgaaaaactgtctaacccagcattgcccaaactattttgacaccaggacctttttctcctttgggatacttatgaacctctcactaatgtcctgtggagaacattttgggaaacactatgttagatagttctttaaggagacaaaacggtaatgaacagatagcactggggcagaatatgcatgcattttgtaacgtccagtgtggcgttgaatagatgtgtatttcctcccctgcagaaaataagcacagaaaattataatgtaggtgatcggagctctttcctttgatagagagaacagccccaatgatcctggctttttcactgaacgtatcagaatacatggatgaattggggtaaataaggttttaattcagatctagaagaaagtattgtacgtttgaatgcagatttttatccacagatagttgtagtgtttagacatgacaggacctatcgttgaggtttctaagacttactatgggctgtaaacctgttttttaaaactattttagaaacctgagacttgccgtctggcattttagtttaatacaaactaatgattgcatttgaaagagattcttgaccttatttctaaacgtctagagctctgaaatgtcttgatggaaggtattaaactatttgcctgttgtacaaagaaatgttaagactcgtgaaaagaattactataaggtactgtgaaataactgcgattttgtgagcaaaacatacttggaaatgctgattgatttttatgcttgttagtgtattgcaagaaacacagaaaatgtagttttgttttaataaacc

SEQ ID NO: 2628 - DNA, 3276 bp, Homo sapiens
ccggcaccgacaagtgcgctgcaccagtggcaccggctgggggcgagccgacctcgagcagccgccgccgccgccgtcgttgctactgccgcagcggagttcagagggcccggaggtgggagacttcccacacggtgactgagatgtcgtccactgcggctttttaccttctctctacgctaggaggatacttggtgacctcattcttgttgcttaaatacccgaccttgctgcaccagagaaagaagcagcgattcctcagtaaacacatctctcaccgcggaggtgctggagaaaatttggagaatacaatggcagcctttcagcatgcggttaaaatcggaactgatatgctagaattggactgccatatcacaaaagatgaacaagttgtagtgtcacatgatgagaatctaaagagagcaactggggtcaatgtaaacatctctgatctcaaatactgtgagctcccaccttaccttggcaaactggatgtctcatttcaaagagcatgccagtgtgaaggaaaagataaccgaattccattactgaaggaagtttttgaggcctttcctaacactcccattaacatcgatatcaaagtcaacaacaatgtgctgattaagaaggtttcagagttggtgaagcggtataatcgagaacacttaacagtgtggggtaatgccaattatgaaattgtagaaaagtgctacaaagagaattcagatattcctatactcttcagtctacaacgtgtcctgctcattcttggccttttcttcactggcctcttgccctttgtgcccattcgagaacagttttttgaaatcccaatgccttctattatactgaagctaaaagaaccacacaccatgtccagaagtcaaaagtttctcatctggctttctgatctcttactaatgaggaaagctttgtttgaccacctaactgctcgaggcattcaagtgtatatttgggtattaaatgaagaacaagaatacaaaagagcttttgatttgggagcaactggggtgatgacagactatccaacaaagcttagggattttttacataacttttcagcatagaaaaagaggtacttagaagtattgaaggaaaaaatgaagacctaagaaaaaaatatttcatgatcatttccctaagccatttccagaatggtaaaaggtttaatcagtttttattacctcatttttaagcctgtatgagaatgtagaaactatatattatatgtatatttattttaaataatattgtatattttatgtttgtaaattgtttagaaagataattggttatgagatgtaagttttaatttcttaatgtgcatttttgtttctagatcttatacagaaatcttgattaataacatacacagaaatgtacatactacatcatctacagaaatcttgatcaataacctagaaactaggttatctaggttattgatcaagatttctgtagatgatgcagtgttctatcataagtaattctggaatcaaagactattggatacatttggcattgggctgagtgtggtggctcatgcctgtaatcccagcactttgggaggctgagacaggcggatcatctgaagtcaggagttaaagaccagcctggccaacatggcaaaaccccatctctaccaaaaatacaaaaattaaccatgcgtggtggtacacgtctgtcatcccagcagctcttaaggctgaggcacaagaattgcttgaacccgggaggcagaggctgtagtgagccaagatagcaccactgcactccagcctgggagacagagtgagactccgtctcaaaaaaaaaaaaaaaaaaaaaaaatgggaggccgaggcgggcggatcacgaggtcaggagatcgagaccatcctggctaacatggtgaaaccccgtctctactaaaaatacaaaaaattagctgggcgtggtggtgggcaccttagtcccagctactcgggaggctgagtcaggagaatggcgtgaacccgggaggcggagcttgcagtgagccgagatcgcgccactgcactccagcctgggctacagagcaagactccgtctcaaaaaaagaaaaaaagaaaaaaaattggcaatagtcttcactggaatacaatcaattagtaaaagattttttttttttttttgacatgtagtcttgctctgtcgccgaggccggagtgcagtggtgcgatcttggctcactgcaacctctgcctcccaggttccagcaattctcctgcctctgcctcccgagtacctgggattacaggtgcctgctaccatgcccagctaatttttgtatttttagtagagacagggttttgccacgttggccagactggtctcgaactcctgacctcaggtgatccacccacctcggcctctcaaagtgctgggattacaggtttgaaccactgcacccggccagtaaaagaaattttgaaggccattgcagctatttggtagtgtcttgttatttctaggtgtaccttagttaaagaggaaaaataaaacggaaaaaagcttggaaatcagtgatgtgtagttatttggcaagttatacataatcagcagcagccaggctcaagaaaataaaagttgattagttgatcagaaataaaatctgtagagtgaattagatttctgagttgttgttgttaatggaacattctatttgagacctttttcaggtgtgtagcaattctaccatgtccatttttttaagcattaaaaaggaacttaccagttgtaaattaagacaagatccaaatagtcatatttttgtgtttcctctaaaaaaatgtaagatttccatttttggcactgactaactgagcctacatctagattttaaataccatcttgaatcctaataattaaactgatgaaagtgcatatcattgttcctaacatttatgaacccccataaagatgttcctgatctttaaaactcattaatctgagtattaagtagaaacagaattttccaaagcattagacatcactttctcagtttatctgaggtgacttcgtgtacatctgtttctaatatatttgactaattttcatgatctcagattgtgaggtaaatgtaatctggaataataagtgtcttttacctagattacatctctcatttggagtttggcaatgaaactgctatgaagaatgactgtactctcctatctgtccctggatgacataaatatcatttgctttgttgtttaaactgaaataaagttttcc

SEQ ID NO: 2629 - DNA, 1265 bp, Homo sapiens
gagcagccgccgccgccgccgtcgttgctactgccgcagcggagttcagagggcccggaggtgggagacttcccacacggtgactgagatgtcgtccactgcggctttttaccttctctctacgctaggaggatacttggtgacctcattcttgttgcttaaatacccgaccttgctgcaccagagaaagaagcagcgattcctcagtaaacacatctctcaccgcggaggtgctggagaaaatttggagaatacaatggcagcctttcagcatgcggttaaaatcggaactgatatgctagaattggactgccatatcacaaaagatgaacaagttgtagtgtcacatgatgagaatctaaagagagcaactggggtcaatgtaaacatctctgatctcaaatactgtgagctcccaccttaccttggcaaactggatgtctcatttcaaagagcatgccagtgtgaaggaaaagataaccgaattccattactgaaggaagtttttgaggcctttcctaacactcccattaacatcgatatcaaagtcaacaacaatgtgctgattaagaaggtttcagagttggtgaagcggtataatcgagaacacttaacagtgtggggtaatgccaattatgaaattgtagaaaagtgctacaaagagaattcagatattcctatactcttcagtctacaacgtgtcctgctcattcttggccttttcttcactggcctcttgccctttgtgcccattcgagaacagttttttgaaatcccaatgccttctattatactgaagctaaaagaaccacacaccatgtccagaagtcaaaagtttctcatctggctttctgatctcttactaatgaggaaagctttgtttgaaccactgcacccggccagtaaaagaaattttgaaggccattgcagctatttggtagtgtcttgttatttctaggtgtaccttagttaaagaggaaaaataaaacggaaaaaagcttggaaatcagtgatgtgtagttatttggcaagttatacataatcagcagcagccaggctcaagaaaataaaagttgattagttgatcagaaataaaatctgtagagtgaattagatttctgagttgttgttgttaatggaacattctatttgagacctttttcaggtgtgtagcaattctaccatgtccatttttttaagcattaaaaaggaacttaccagttgtaaattaagacaagatccaaatagtcatatttttgtgtttc

SEQ ID NO: 2630 - DNA, 1055 bp, Homo sapiens
ggagttcagagggcccggaggtgggagacttcccacacggtgactgagatgtcgtccactgcggctttttaccttctctctacgctaggaggatacttggtgacctcattcttgttgcttaaatacccgaccttgctgcaccagagaaagaagcagcgattcctcagtaaacacatctctcaccgcggaggtgctggagaaaatttggagaatacaatggcagcctttcagcatgcggttaaaatcggaactgatatgctagaattggactgccatatcacaaaagatgaacaagttgtagtgtcacatgatgagaatctaaagagagcaactggggtcaatgtaaacatctctgatctcaaatactgtgagctcccaccttaccttggcaaactggatgtctcatttcaaagagcatgccagtgtgaaggaaaagataaccgaattccattactgaaggaagtttttgaggcctttcctaacactcccattaacatcgatatcaaagtcaacaacaatgtgctgattaagaaggtttcagagttggtgaagcggtataatcgagaacacttaacagtgtggggtaatgccaattatgaaattgtagaaaagtgctacaaagagaattcagatattcctatactcttcagtctacaacgtgtcctgctcattcttggccttttcttcactggcctcttgccctttgtgcccattcgagaacagttttttgaaatcccaatgccttctattatactgaagctaaaagaaccacacaccatgtccagaagtcaaaagtttctcatctggctttctgatctcttactaatgaggaaagctttgtttgaccacctaactgctcgaggcattcaagtaagtttctggaatgatgcattttggaagcagcatagctcaccagtttaacacaaatataaagggcaagaacttttaactgacttagtttggcccttgactctgatgctgctgctttactgatccacaaatgaggaccttaagctcttccttacacttagcaataaagcattggcatttctgga

SEQ ID NO: 2631 - DNA, 2169 bp, Homo sapiens
gcagatttgctctccctcccgcttcctccctcccatcttcccacccgggctgtgcccaggccacagagcagctgcaggccttgggagaggacccacacagcctcctgtaggtggcaacagtgccacctgtttgactcatagggctgaaccgaggactgaaaaagggaggaggcagaccactcggagaggagctgggaagcagtgcagagaggagagcggagcggagctgccgctgagcaaaggccttcaccatggccgagtcccccggctgctgctccgtctgggcccgctgcctccactgcctgtatagctgccactggaggaaatgccccagagagaggatgcaaaccagcaagtgcgactgtatctggtttggcctgctcttcctcaccttcctcctttccctgagctggctgtacatcgggctcgtccttctcaatgacctgcacaacttcaatgaattcctcttccgccgctggggacactggatggactggtccctggcattcctgctggtcatctctctactggtcacatatgcatccttgctattggtcctggccctgctcctgcggctttgtagacagcccctgcatctgcacagcctccacaaggtgctgctgctcctcattatgctgcttgtggcggctggccttgtgggactggacatccaatggcagcaggagtggcatagcttgcgtgtgtcactgcaggccacagccccattccttcatattggagcagccgctggaattgccctcctggcctggcctgtggctgataccttctaccgtatccaccgaagaggtcccaagattctgctactgctcctattttttggagttgtcctggtcatctacttggcccccctatgcatctcctcaccctgcatcatggaacccagagacttaccacccaagcctgggctggtgggacaccgaggggcccccatgctggctcccgagaacaccctgatgtccttgcggaagacagctgaatgcggagctactgtgtttgagactgatgtgatggtcagctccgatggggtccccttcctcatgcatgatgagcacctcagcaggaccacgaatgtagcctctgtattcccaacccgaatcacagcccacagcagtgacttctcctggactgaactgaagagactcaatgctggatcctggttcctagagaggcgacccttctggggggccaaaccgctggcaggccctgatcagaaagaggctgagagtcagacggtaccagcattagaagagctattggaggaagctgcagccctcaacctttccatcatgttcgacttgcgccgacccccacagaaccacacatactatgacacttttgtgatccagacattggagactgtgctgaatgcaagggtgccccaagccatggtcttttggctaccagatgaagatcgggctaatgtccaacgacgggcacctggaatgcgccagatatatggacgtcagggaggcaacagaacggagaggccccagtttcttaacctcccctatcaagatctgccactattggatatcaaggcattgcataaggataatgtctcggtgaacctatttgtagtgaacaagccctggctcttctctctgctttggtgtgcaggggtggattcggtcaccaccaacgactgccagctgctgcagcagatgcgttaccctatctggcttattacccctcaaacctacctaatcatatgggtcattaccaattgtgtttccaccatgctgcttttgtggaccttcctcctccaaagaagatttgttaagaagagagggaaaactggcttagaaacagcagtgctgctgacaaggatcaacaatttcatgatggagtgaatgccctgccctgcttccccacccaagccagtctacattgcccaaacagcaagggttggagagtggcttaagtggaatgcttcaggggtggtgggttgcaagtggggggagctttgccaacaggaggttttgaaccatgagggccctctgcccaggtgatgggcattccctaagctgctatggaatctgctccctttggggttttgacctgagatgtttgggaagagagtgagtaatgagaagtttctcctcaaatgaaactagaacagaggaagtaaaagggagattgctcggataa

SEQ ID NO: 2632 - DNA, 2438 bp, Homo sapiens
aaagccccggcagtgactgggaggggaacaggaggagggacagagggatgggaaagcctgcacaaaggaattcctcaccccaagccccctgaccgccagcgagtaaagaagcagatttgctctccctcccgcttcctccctcccatcttcccacccgggctgtgcccaggccacagagcagctgcaggccttgggagaggacccacacagcctcctgtaggtggcaacagtgccacctgtttgactcatagggctgaaccgaggactgaaaaagggaggaggcagaccactcggagaggagctgggaagcagtgcagagaggagagcggagcggagctgccgctgagcaaaggccttcaccatggccgagtcccccggctgctgctccgtctgggcccgctgcctccactgcctgtatagctgccactggaggaaatgccccagagagaggatgcaaaccagcaagtgcgactgtatctggtttggcctgctcttcctcaccttcctcctttccctgagctggctgtacatcgggctcgtccttctcaatgacctgcacaacttcaatgaattcctcttccgccgctggggacactggatggactggtccctggcattcctgctggtcatctctctactggtcacatatgcatccttgctattggtcctggccctgctcctgcggctttgtagacagcccctgcatctgcacagcctccacaaggtgctgctgctcctcattatgctgcttgtggcggctggccttgtgggactggacatccaatggcagcaggagtggcatagcttgcgtgtgtcactgcaggccacagccccattccttcatattggagcagccgctggaattgccctcctggcctggcctgtggctgataccttctaccgtatccaccgaagaggtcccaagattctgctactgctcctattttttggagttgtcctggtcatctacttggcccccctatgcatctcctcaccctgcatcatggaacccagagacttaccacccaagcctgggctggtgggacaccgaggggcccccatgctggctcccgagaacaccctgatgtccttgcggaagacagctgaatgcggagctactgtgtttgagactgatgtgatggtcagctccgatggggtccccttcctcatgcatgatgagcacctcagcaggaccacgaatgtagcctctgtattcccaacccgaatcacagcccacagcagtgacttctcctggactgaactgaagagactcaatgctggatcctggttcctagagaggcgacccttctggggggccaaaccgctggcaggccctgatcagaaagaggctgagagtcagacggtaccagcattagaagagctattggaggaagctgcagccctcaacctttccatcatgttcgacttgcgccgacccccacagaaccacacatactatgacacttttgtgatccagacattggagactgtgctgaatgcaagggtgccccaagccatggtcttttggctaccagatgaagatcgggctaatgtccaacgacgggcacctggaatgcgccagatatatggacgtcagggaggcaacagaacggagaggccccagtttcttaacctcccctatcaagatctgccactattggatatcaaagacaggttcctactacctgcccaggctggtctcaaactactggcctcaagcaatcttcctgcctcggcctcccaaagtgctgggattacaggcctgagccactgcccccctcagcctcccggttataagcatgagctatctcacctagctatggcattgcataaggataatgtctcggtgaacctatttgtagtgaacaagccctggctcttctctctgctttggtgtgcaggggtggattcggtcaccaccaacgactgccagctgctgcagcagatgcgttaccctatctggcttattacccctcaaacctacctaatcatatgggtcattaccaattgtgtttccaccatgctgcttttgtggaccttcctcctccaaagaagatttgttaagaagagagggaaaactggcttagaaacagcagtgctgctgacaaggatcaacaatttcatgatggagtgaatgccctgccctgcttccccacccaagccagtctacattgcccaaacagcaagggttggagagtggcttaagtggaatgcttcaggggtggtgggttgcaagtggggggagctttgccaacaggaggttttgaaccatgagggccctctgcccaggtgatgggcattccctaagctgctatggaatctgctccctttggggttttgacctgagatgtttgggaagagagtgagtaatgagaagtttctcctcaaatgaaactagaacagaggaagtaaaagggagattgctcggataatgtctc

SEQ ID NO: 2633 - DNA, 2171 bp, Homo sapiens
aaagccccggcagtgactgggaggggaacaggaggagggacagagggatgggaaagcctgcacaaaggaattcctcaccccaagccccctgaccgccagcgagtaaagaagcagatttgctctccctcccgcttcctccctcccatcttcccacccgggctgtgcccaggccacagagcagctgcaggccttgggagaggacccacacagcctcctgtaggtggcaacagtgccacctgtttgactcatagggctgaaccgaggactgaaaaagggaggaggcagaccactcggagaggagctgggaagcagtgcagagaggagagcggagcggagctgccgctgagcaaagtgcgactgtatctggtttggcctgctcttcctcaccttcctcctttccctgagctggctgtacatcgggctcgtccttctcaatgacctgcacaacttcaatgaattcctcttccgccgctggggacactggatggactggtccctggcattcctgctggtcatctctctactggtcacatatgcatccttgctattggtcctggccctgctcctgcggctttgtagacagcccctgcatctgcacagcctccacaaggtgctgctgctcctcattatgctgcttgtggcggctggccttgtgggactggacatccaatggcagcaggagtggcatagcttgcgtgtgtcactgcaggccacagccccattccttcatattggagcagccgctggaattgccctcctggcctggcctgtggctgataccttctaccgtatccaccgaagaggtcccaagattctgctactgctcctattttttggagttgtcctggtcatctacttggcccccctatgcatctcctcaccctgcatcatggaacccagagacttaccacccaagcctgggctggtgggacaccgaggggcccccatgctggctcccgagaacaccctgatgtccttgcggaagacagctgaatgcggagctactgtgtttgagactgatgtgatggtcagctccgatggggtccccttcctcatgcatgatgagcacctcagcaggaccacgaatgtagcctctgtattcccaacccgaatcacagcccacagcagtgacttctcctggactgaactgaagagactcaatgctggatcctggttcctagagaggcgacccttctggggggccaaaccgctggcaggccctgatcagaaagaggctgagagtcagacggtaccagcattagaagagctattggaggaagctgcagccctcaacctttccatcatgttcgacttgcgccgacccccacagaaccacacatactatgacacttttgtgatccagacattggagactgtgctgaatgcaagggtgccccaagccatggtcttttggctaccagatgaagatcgggctaatgtccaacgacgggcacctggaatgcgccagatatatggacgtcagggaggcaacagaacggagaggccccagtttcttaacctcccctatcaagatctgccactattggatatcaaggcattgcataaggataatgtctcggtgaacctatttgtagtgaacaagccctggctcttctctctgctttggtgtgcaggggtggattcggtcaccaccaacgactgccagctgctgcagcagatgcgttaccctatctggcttattacccctcaaacctacctaatcatatgggtcattaccaattgtgtttccaccatgctgcttttgtggaccttcctcctccaaagaagatttgttaagaagagagggaaaactggcttagaaacagcagtgctgctgacaaggatcaacaatttcatgatggagtgaatgccctgccctgcttccccacccaagccagtctacattgcccaaacagcaagggttggagagtggcttaagtggaatgcttcaggggtggtgggttgcaagtggggggagctttgccaacaggaggttttgaaccatgagggccctctgcccaggtgatgggcattccctaagctgctatggaatctgctccctttggggttttgacctgagatgtttgggaagagagtgagtaatgagaagtttctcctcaaatgaaactagaacagaggaagtaaaagggagattgctcggataatgtctc

SEQ ID NO: 2634 - DNA, 2067 bp, Homo sapiens
aaagccccggcagtgactgggaggggaacaggaggagggacagagggatgggaaagcctgcacaaaggaattcctcaccccaagccccctgaccgccagcgagtaaagaagcagatttgctctccctcccgcttcctccctcccatcttcccacccgggctgtgcccaggccacagagcagctgcaggccttgggagaggacccacacagcctcctgtaggtggcaacagtgccacctgtttgactcatagggctgaaccgaggactgaaaaagggaggaggcagaccactcggagaggagctgggaagcagtgcagagaggagagcggagcggagctgccgctgagcaaagattcctcttccgccgctggggacactggatggactggtccctggcattcctgctggtcatctctctactggtcacatatgcatccttgctattggtcctggccctgctcctgcggctttgtagacagcccctgcatctgcacagcctccacaaggtgctgctgctcctcattatgctgcttgtggcggctggccttgtgggactggacatccaatggcagcaggagtggcatagcttgcgtgtgtcactgcaggccacagccccattccttcatattggagcagccgctggaattgccctcctggcctggcctgtggctgataccttctaccgtatccaccgaagaggtcccaagattctgctactgctcctattttttggagttgtcctggtcatctacttggcccccctatgcatctcctcaccctgcatcatggaacccagagacttaccacccaagcctgggctggtgggacaccgaggggcccccatgctggctcccgagaacaccctgatgtccttgcggaagacagctgaatgcggagctactgtgtttgagactgatgtgatggtcagctccgatggggtccccttcctcatgcatgatgagcacctcagcaggaccacgaatgtagcctctgtattcccaacccgaatcacagcccacagcagtgacttctcctggactgaactgaagagactcaatgctggatcctggttcctagagaggcgacccttctggggggccaaaccgctggcaggccctgatcagaaagaggctgagagtcagacggtaccagcattagaagagctattggaggaagctgcagccctcaacctttccatcatgttcgacttgcgccgacccccacagaaccacacatactatgacacttttgtgatccagacattggagactgtgctgaatgcaagggtgccccaagccatggtcttttggctaccagatgaagatcgggctaatgtccaacgacgggcacctggaatgcgccagatatatggacgtcagggaggcaacagaacggagaggccccagtttcttaacctcccctatcaagatctgccactattggatatcaaggcattgcataaggataatgtctcggtgaacctatttgtagtgaacaagccctggctcttctctctgctttggtgtgcaggggtggattcggtcaccaccaacgactgccagctgctgcagcagatgcgttaccctatctggcttattacccctcaaacctacctaatcatatgggtcattaccaattgtgtttccaccatgctgcttttgtggaccttcctcctccaaagaagatttgttaagaagagagggaaaactggcttagaaacagcagtgctgctgacaaggatcaacaatttcatgatggagtgaatgccctgccctgcttccccacccaagccagtctacattgcccaaacagcaagggttggagagtggcttaagtggaatgcttcaggggtggtgggttgcaagtggggggagctttgccaacaggaggttttgaaccatgagggccctctgcccaggtgatgggcattccctaagctgctatggaatctgctccctttggggttttgacctgagatgtttgggaagagagtgagtaatgagaagtttctcctcaaatgaaactagaacagaggaagtaaaagggagattgctcggataatgtctc

SEQ ID NO: 2635 - DNA, 1305 bp, Homo sapiens
agcacagtcccgcggacggctgagcgtgtggctgcaggagcttctgtgggagtacggtcatgagccttttgctgtactatgccctccctgccctgggcagctatgccatgctctccatcttcttcctgcgccggcctcatctgctgcacacgcccagggctcccaccttccgcatccgcctgggggcccaccgaggaggatctggagagctgctggagaacaccatggaggccatggagaagtgagtgtatctgcccctgcccaggctgccatgtgagggtgtgcaggtcgtggactgcatcacagcaagggacgccattcacttcctagctgggtgactggcgccccctggaggtggcctgcacatcccgccacgaactccgctctcacattcccggccacctcccagccaccatgcccctcatcccagtcccctgcccctgccccccgctgaccttcacccccacagctccatggcccagcgctcggacctcctggagctcgactgtcagctgacacgggacagagtggtggtggtgtcacatgatgagaacctgtgccgccagtcgggcctaaacagggatgtgggcagcctggacttcgaggacctgcccctctacaaggagaagctggaggtttacttctctccaggccactttgctcacgggtcagaccggcgcatggttcgtctggaggacctgttccagaggtttccaaggacacccatgagcgtagagatcaaagggaagaacgaagagctcatccgtgagatagcaggcttggtgagacgctatgaccgtaatgaaatcaccatctgggcctcggagaagagctcggtcatgaagaaatgcaaggctgccaaccccgagatgcccctgtccttcacaataagccgaggattctgggtgctgctttcctactacctggggctgctgcccttcatcccaatccctgagaagttcttcttctgcttcctgcccaacatcatcaacaggacctatttcccattttcctgctcttgcctgaaccagttattggctgtggtttcgaaatggctgatcatgaggaagagtctgatccgacacttggaggagcgaggggtgcaggtggtcttttggtgccttaatgaagagtcggattttgaagcagccttcagcgtgggagccactggcgtcataacggattatcccacagccctgcggcactacctggacaaccatggaccagctgcccggacctcctaagtccagaagcctcgaggtctcctgtttctcttcctgaaaaataaatatttgcctttcgatc

SEQ ID NO: 2636 - DNA, 1397 bp, Homo sapiens
cctacacacccctggatcctctgaaatggcaaggggtaggcatgttggatgcgctggctacaagtaccagtgagagggagaggtcctgacagtcctgggtggtttttactcccctcatgtagcccaggacggggctgctgggggctgggaagggcctggggatatgagagccagggctacttgcctcacctcctgacactaccccagcttcagccgaaccctgcagcctggctccaagccagcccagcggcaggctcagcaggtcccaggggcgtggcagtggccagtagtagagccggcccacactggctaggcaggcagcacagtcccgcggacggctgagcgtgtggctgcaggagcttctgtgggagtacggtcatgagccttttgctgtactatgccctccctgccctgggcagctatgccatgctctccatcttcttcctgcgccggcctcatctgctgcacacgcccagggctcccaccttccgcatccgcctgggggcccaccgaggaggatctggagagctgctggagaacaccatggaggccatggagaactccatggcccagcgctcggacctcctggagctcgactgtcagctgacacgggacagagtggtggtggtgtcacatgatgagaacctgtgccgccagtcgggcctaaacagggatgtgggcagcctggacttcgaggacctgcccctctacaaggagaagctggaggtttacttctctccaggccactttgctcacgggtcagaccggcgcatggttcgtctggaggacctgttccagaggtttccaaggacacccatgagcgtagagatcaaagggaagaacgaagagctcatccgtgagatagcaggcttggtgagacgctatgaccgtaatgaaatcaccatctgggcctcggagaagagctcggtcatgaagaaatgcaaggctgccaaccccgagatgcccctgtccttcacaataagccgaggattctgggtgctgctttcctactacctggggctgctgcccttcatcccaatccctgagaagttcttcttctgcttcctgcccaacatcatcaacaggacctatttcccattttcctgctcttgcctgaaccagttattggctgtggtttcgaaatggctgatcatgaggaagagtctgatccgacacttggaggagcgaggggtgcaggtggtcttttggtgccttaatgaagagtcggattttgaagcagccttcagcgtgggagccactggcgtcataacggattatcccacagccctgcggcactacctggacaaccatggaccagctgcccggacctcctaagtccagaagcctcgaggtctcctgtttctcttcctgaaaaataaatatttgcctttcgatca

SEQ ID NO: 2637 - DNA, 2533 bp, Homo sapiens
aaagggtgaatcatgtttaagaaggtcaacaggattgagcacaagaggaataagacagaaaaaccaaaaaagcttaatccatggattccacgcatcttcaaccacaaatgctttgtcaccttccttactggctgctatagttgcctctggaaattcagacaatgggaaaaaactaaagttggattttgttgctgcacttggaaagagcaattattttgccgtgcctggtaatttcatttgtcttgtctctgatgttgctgttcctgtggatagaaacatccagtgaatactttaactttgactgggtcacttttctaggaacaggatactggtttttctggtctatttttattctgagtttagctaggatcctgactgcctactcttcattgctgttgttacttggatttttgttgctttgggaaaggattgaactatacctgcacttgtgtcataagatcctgattctgctagtgattcttctgtgtgtcattttaatgttcattatatgcaaattctggaaagaaaggtggctggtagctgggctgtcaatgcagatctttgctccctacgtgcacctggtcagcataactgtgatggttatccttttctggcctgtggccttctacgtggcatgtttggaaagagaagttagaatgagaagatacaggatgacacattctgagaaaaaaagactcaagcaatgtaatgtaatcacaaggttaagaggtctacaagtgcctgttggattaccctttcttcttatccttttaggtctctatttgatgccactggggatttattctccctgcattcaggagaaggagaatttggggcccaagccaaccatctttggacatagaggtgcacccatgttggggcctgagaataccatgatgtcctttgagaaagctgttgaacatggagcccatggattggagactgatatacacttaagttatgatcatgtgcctttcctcatgcatgactttgacctgaaaagaacaaccaatattggggaagttcagccagaatctgcctgcgagaaccctgccttcttcaactgggatttcctatcgactctgaatgcaggcaaatggtttgtaaaaccagagctcaggccattttacaatatgaaacctctatcagaggcagataaagaaagagcaagaaatcagtcaattccaacactagctgatttattgacacttgcagagaaggaaagaaaatttgtgatatttgatcttcatcgccctccaccaaaacatcctctcagacacacatttgtccgccaagtagtaagcgtgatccttgcctctaaaatcgagcaacatctgattttttggttgccagctcatgataggcaatacgtcaggtccgtggctcctggttttcagcatgtgggccgtttagtatccattgaaacccttgctaaaaacaatatcagtataataaatgttgactacaagaagttgttccctaatgggttaagagattataaagcagctaacatccatatcaacgtatacaccgtcaatgagccttggcttttctcactggcctggtgctccaggattaactcagtgaccacagacaacattgggctcctgagtcagcttgatcaccctcacttcttcatgacaccaaagttctatgtgttcatgtggctccttgcagatatcatttctgtgctttttattgttgccatattttgttttcactggcggagagagactgaaaaagaaaaattgtttgaaacctccagcactcgcacagatactcagagtggaagtaagaatgaggaagatagatagatagatagatttgcacatagccatgaaacctcctgtccgagttgtggaaggtccttggactctagcagccctctacccggctctacccaagagtggaaaggaacaccaaggccatttcaattttgcagcaccatccaagaaactactacctatcaagaatgctgtcacacctttgaagcctggcaagcatgagattcaaccaccgatgcccaccgtggtctttgaactcacccaagcacccaccaggcaggctacaagtgaggctacctttcaaactacattgcccaccctgaaggtggataagccaaccatgccctccatagaggtcccctatccttaaataagagacctctaagagatccccatggctgaatactccaaataatcctatgtcacaatatattccattgcatctgacatagccttctgtgtttccaaagaagaattagccacatctcccctgcttcttcctctctctgcctaagggtggtgatggtggggagtggttgataaaggcacacagaagggccacggaggctctcaggggaaccattgtgctctcgctatcaagaatgcatctcaaggggctaggcaaggggaaaactgctgtgtgtggtcttggaactggttgctgtcaggtttatctcatcctaacacctccataatattttctgctaaaggagtgactgtgcatataagtaaaggcaacctctcaggaa

SEQ ID NO: 2638 - DNA, 2502 bp, Homo sapiens
aaagggtgaatcatgtttaagaaggtcaacaggattgagcacaagaggaataagacagaaaaaccaaaaaagcttaatccatggattccacgcatcttcaaccacaaatgctttgtcaccttccttactggctgctatagttgcctctggaaattcagacaatgggaaaaaactaaagttggattttgttgctgcacttggaaagagcaattattttgccgtgcctggtaatttcatttgtcttgtctctgatgttgctgttcctgtggatagaaacatccagtgaatactttaactttgactgggtcacttttctaggaacaggatactggtttttctggtctatttttattctgagtttagctaggatcctgactgcctactcttcattgctgttgttacttggatttttgttgctttgggaaaggattgaactatacctgcacttgtgtcataagatcctgattctgctagtgattcttctgtgtgtcattttaatgttcattatatgcaaattctggaaagaaaggtggctggtagctgggctgtcaatgcagatctttgctccctacgtgcacctggtcagcataactgtgatggttatccttttctggcctgtggccttctacgtggcatgtttggaaagagaagttagaatgagaagatacaggatgacacattctgagaaaaaaagactcaagcaatgtaatgtaatcacaaggttaagaggtctacaagtgcctgttggattaccctttcttcttatccttttaggtctctatttgatgccactggggatttattctccctgcattcaggagaaggagaatttggggcccaagccaaccatctttggacatagaggtgcacccatgttggggcctgagaataccatgatgtcctttgagaaagctgttgaacatggagcccatggattggagactgatatacacttaagttatgatcatgtgcctttcctcatgcatgactttgacctgaaaagaacaaccaatattggggaagttcagccagaatctgcctgcgagaaccctgccttcttcaactgggatttcctatcgactctgaatgcaggcaaatggtttgtaaaaccagagctcaggccattttacaatatgaaacctctatcagaggcagataaagaaagagcaagaaatcagtcaattccaacactagctgatttattgacacttgcagagaaggaaagaaaatttgtgatatttgatcttcatcgccctccaccaaaacatcctctcagacacacatttgtccgccaagtagtaagcgtgatccttgcctctaaaatcgagcaacatctgattttttggttgccagctcatgataggcaatacgtcaggtccgtggctcctggttttcagcatgtgggccgtttagtatccattgaaacccttgctaaaaacaatatcagtataataaatgttgactacaagaagttgttccctaatgggttaagagattataaagcagctaacatccatatcaacgtatacaccgtcaatgagccttggcttttctcactggcctggtgctccaggattaactcagtgaccacagacaacattgggctcctgagtcagcttgatcaccctcacttcttcatgacaccaaagttctatgtgttcatgtggctccttgcagatatcatttctgtgctttttattgttgccatattttgttttcactggcggagagagactgaaaaagaaaaattgtttgaaacctccagcactcgcacagatactcagagtggaaatttgcacatagccatgaaacctcctgtccgagttgtggaaggtccttggactctagcagccctctacccggctctacccaagagtggaaaggaacaccaaggccatttcaattttgcagcaccatccaagaaactactacctatcaagaatgctgtcacacctttgaagcctggcaagcatgagattcaaccaccgatgcccaccgtggtctttgaactcacccaagcacccaccaggcaggctacaagtgaggctacctttcaaactacattgcccaccctgaaggtggataagccaaccatgccctccatagaggtcccctatccttaaataagagacctctaagagatccccatggctgaatactccaaataatcctatgtcacaatatattccattgcatctgacatagccttctgtgtttccaaagaagaattagccacatctcccctgcttcttcctctctctgcctaagggtggtgatggtggggagtggttgataaaggcacacagaagggccacggaggctctcaggggaaccattgtgctctcgctatcaagaatgcatctcaaggggctaggcaaggggaaaactgctgtgtgtggtcttggaactggttgctgtcaggtttatctcatcctaacacctccataatattttctgctaaaggagtgactgtgcatataagtaaaggcaacctctcaggaa

SEQ ID NO: 2639 - DNA, 1795 bp, Homo sapiens
gtgcctttaaattactgctttcggagggtgcatctagggggaggtgggaggcaggaaaacatcttcctaccggtctccctcctccctcccctccaagactcttcagggtttggagagtgattgctgcccagagagaatcttttccagctcccagctggcaggctaaggccctccggagcccaaggcgagcccaagcagaagccagtagggttatctgtgtcaggatcatttccaggggaatagttctggcccctggcaggtaaagacaggccagaggagaagaggcagaagaggagagaaagcaggctcttttgcgagcagcccaggttggagaaaggctctgtacttttggcgttcctgcagggatatcccctctcacattggcagccaggctgagaaagggcttcaagatccccgcagaatgacaactcttgttcctgcaaccctctccttccttcttctctggaccctgccagggcaggtcctcctcagggtggccttggcaaaagaggaagtcaaatctggaaccaaggggtcccagcccatgtccccctctgatttcctagacaaacttatggggcgaacatctggatatgatgccaggattcggcccaattttaaaggcccacccgtgaacgtgacctgcaacatcttcatcaacagtttcagctccatcaccaagaccacaatggactaccgggtgaatgtcttcttgcggcaacagtggaatgacccacgcctgtcctaccgagaatatcctgatgactctctggacctcgatccctccatgctggactctatctggaagccagacctcttctttgctaatgagaaaggggccaacttccatgaggtgaccacggacaacaagttactgcgcatcttcaagaatgggaatgtgctgtacagcatcaggctgaccctcattttgtcctgcctgatggacctcaagaacttccccatggacatccagacctgcacgatgcagcttgagagctttggctacaccatgaaagacctcgtgtttgagtggctggaagatgctcctgctgtccaagtggctgaggggctgactctgccccagtttatcttgcgggatgagaaggatctaggctgttgtaccaagcactacaacacagggaaattcacctgcatcgaggtaaagtttcacctggaacggcagatgggctactatctgattcagatgtacatccccagcctactcatcgtcatcctgtcctgggtctccttctggatcaacatggatgctgcccctgcccgtgtgggcctgggcatcaccaccgtgctcaccatgaccacccagagctctggctcccgggcctctttgcctaaggtgtcctacgtgaaggcaatcgacatctggatggctgtgtgtctgctctttgtgttcgctgccttgctggagtatgctgccataaattttgtttctcgtcagcataaagaattcatacgacttcgaagaaggcagaggcgccaacgcttggaggaagatatcatccaagaaagtcgtttctatttccgtggctatggcttgggccactgcctgcaggcaagagatggaggtccaatggaaggttctggcatttatagtccccaacctccagcccctcttctaagggaaggagaaaccacgcggaaactctacgtggactgagccaagagaattgacaccatctcccgggctgtcttccctttcactttcctcatcttcaatatcttctactgggttgtctataaagtgctatggtcagaagatatccaccaggctctgtga

SEQ ID NO: 2640 - DNA, 2068 bp, Homo sapiens
agtgttggccaatcccagcagccatacttcaactactcatagactgctgaatgttcaaactgtgttcaaataagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatcaaaaatgaatgtccctgctatttctggatttatgaggcaatggtacactaaagaatggaatcagttcagtgaatagaaaggtatccaaggtgaagcctgagacgaatggctttcccaggctaccttccatcactgttgtacagaaaagaaatccagagaatcaaatggactggccttgggggtctctgctatggaaatgccattttttgtgtctcctttctcctactctttctcacatcctcttcatgattgaagcatggcacaaggcaaggtgttgcctgcgagtctggttgtaagttcagcctttggtgtttgcactactgctatcataaggggtcagggacattccggggagaagtgaccactaaggtgaggattagagagtgagtagaagtgagccagacaaaaaaagcagaaaatgcagatgatggaaaggacatgtgccatgcactatcataagaacttcctaactgaacactgatactacaattctgaatccctgatcttaaaaaataattatacttcaccaacaaaacttggcctcttttggttccactctgccaccctgccattggaacttggattactgtgaacattgcagctatagcaaaat

SEQ ID NO: 2641 - DNA, 1627 bp, Homo sapiens
gatcgctttgccaattttgcgttactgggcaggctaagagatcttcttttaattcagcctgcttaagacgggaactgataactgtagtgtatcctctgccttttttcttatctattggaggaagctcaggtgaagaaatggagttgccatcaactaagttgagaaagactacagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataa

SEQ ID NO: 2642 - DNA, 1754 bp, Homo sapiens
agcttctaatgcccttttttaaccctttaggtatctgatcgctttgccaattttgcgttactgggcaggctaagagatcttcttttaattcagcctgcttaagacgggaactgataactgtagtgtatcctctgccttttttcttatctattggaggaagctcaggtgaagaaatggagttgccatcaactaagttgagaaagactacagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatcaaaaatgaatgtccctgctatttctggatttatgaggcaatggtacactaaagaatggaatcagttcagtgaatagaaaggtatccaaggtgaagcctgagacgaatggctttcccaggctaccttccatcactg

SEQ ID NO: 2643 - DNA, 573 bp, Homo sapiens
agttttttctcactgcttgcttggcaatgcagctctagcttctaatgcccttttttaaccctttaggtatctgatcgctttgccaattttgcgttactgggcaggctaagagatcttcttttaattcagcctgcttaagacgggaactgataactgtagtgtatcctctgccttttttcttatctattggaggaagctcagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatgga

SEQ ID NO: 2644 - DNA, 571 bp, Homo sapiens
ggctcagttgccatgggccaggagtctcacagaactactaagcagctgcttacccaattttggctggagagataagtaccctctggggccaccacagctggccccaaccatggtcctgattgccttggaagaactgcctttggaatttcacatcggcatccagatagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctcca

SEQ ID NO: 2645 - DNA, 1636 bp, Homo sapiens
aattgacttaatattgttctagaatagcctttcagctacaagaggttatatataaatcaaaagcttcttgagtaaaacttcttagaattgtagaagctgctcaatatggaacatattctcagtcctcctctggtctacaaagcctgtgatttcttgtctatggacagaacgtctggtttaatctacaggaacccataacttcctgaagctttatgcttaacagtgacaacgtgagtcagttgaattttattgtgtttcagtccgtagagtattagctacagaaacctttccattgccatactgagaaactgcagcaggcagtgtgcctacaggtctacaaagaaacttcagatcatcttcttgagggaaagaagctgaagtgctacataagatgcttgtgcttcataactctcagaagctgcagattctgtataaatccttagaaaagagcatccctgaatccataaaggtatatggcgccattttcaacataaaagataaaaaccctttcaacatggaggtgctggtagatgcctggccagattaccagatcgtcattacccggcctcagaaacaggagatgaaagatgaccaggatcattataccaacacttaccacatcttcaccaaagctcctgacaaattagaggaagtcctgtcatactccaatgtaatcagctgggagcaaactttgcagatccaaggttgccaagagggcttggatgaagcaataagaaaggttgcaacttcaaaatcagtgcaggtagattacatgaaaaccatcctctttataccggaattaccaaagaaacacaagacctcaagtaatgacaagatggagttatttgaagtggatgatgataacaaggaaggaaacttttcaaacatgttcttagatgcttcacatgcaggtcttgtgaatgaacactgggcctttgggaaaaatgagaggagcttgaaatatattgaacgctgcctccaggattttctaggatttggtgtgctgggtccagagggccagcttgtctcttggattgtgatggaacagtcctgtgagttgagaatgggttatactgtccccaaatacagacaccaaggcaacatgttgcaaattggttatcatcttgaaaagtatctttctcagaaagaaatcccattttatttccatgtggcagataataatgagaaaagcctacaggcactgaacaatttggggtttaagatttgtccttgtggctggcatcagtggaaatgcacccccaagaaatattgttgattgattccactgtccatttcaaatctttcttatcagtaaaaaaacattaattcaaacacaagcattgtgatctacattagcacaaaatgcaactgattatctaggatctgtgtattacttaagctcacccttaacagttttaccttccttctcctctgtattcttacagaaaattagaagctcaattttatggtctcataatttcctttatgacagacatctcagaattaaaatcacccaaagccaatcattagtgccaagataaccctttaacggcaacactttcttaaatgaagactatttctttcatgaaaaaattcacttttatgactttcttgttaaaataaaaagtctgctttt

SEQ ID NO: 2646 - DNA, 1488 bp, Homo sapiens
agtccgtagagtattagctacagaaacctttccattgccatactgagaaactgcagcaggcagtgtgcctacaggtctacaaagaaacttcagagtctcacactgtcacccaggctggaatgcagtggtgcgatatcagatcactgcaacctcctcttccttggttcaagcaattctcctgcctcagcctcctgagtagctgggactactgacactcaccaccacacccagatcatcttcttgagggaaagaagctgaagtgctacataagatgcttgtgcttcataactctcagaagctgcagattctgtataaatccttagaaaagagcatccctgaatccataaaggtatatggcgccattttcaacataaaagataaaaaccctttcaacatggaggtgctggtagatgcctggccagattaccagatcgtcattacccggcctcagaaacaggagatgaaagatgaccaggatcattataccaacacttaccacatcttcaccaaagctcctgacaaattagaggaagtcctgtcatactccaatgtaatcagctgggagcaaactttgcagatccaaggttgccaagagggcttggatgaagcaataagaaaggttgcaacttcaaaatcagtgcaggtagattacatgaaaaccatcctctttataccggaattaccaaagaaacacaagacctcaagtaatgacaagatggagttatttgaagtggatgatgataacaaggaaggaaacttttcaaacatgttcttagatgcttcacatgcaggtcttgtgaatgaacactgggcctttgggaaaaatgagaggagcttgaaatatattgaacgctgcctccaggattttctaggatttggtgtgctgggtccagagggccagcttgtctcttggattgtgatggaacagtcctgtgagttgagaatgggttatactgtccccaaatacagacaccaaggcaacatgttgcaaattggttatcatcttgaaaagtatctttctcagaaagaaatcccattttatttccatgtggcagataataatgagaaaagcctacaggcactgaacaatttggggtttaagatttgtccttgtggctggcatcagtggaaatgcacccccaagaaatattgttgattgattccactgtccatttcaaatctttcttatcagtaaaaaaacattaattcaaacacaagcattgtgatctacattagcacaaaatgcaactgattatctaggatctgtgtattacttaagctcacccttaacagttttaccttccttctcctctgtattcttacagaaaattagaagctcaattttatggtctcataatttcctttatgacagacatctcagaattaaaatcacccaaagccaatcattagtgccaagataaccctttaacggcaacactttcttaaatgaagactatttctttcatgaaaaaattcacttttatgact

SEQ ID NO: 2647 - DNA, 1113 bp, Homo sapiens
aagaataaacttaccatttatataaaagggctactggactgatacacagctgaaaaccctcagttctggactgaactcccagcaggtgtggagttgcaagagctctggaaaagatgttggtgctaaactgttctaccaaattactgatactggagaaaatgttgaagagttgctttcctgaatcactcaaggtttacggagcggtgatgaacataaatcgtgggaacccctttcaaaaggaagtggtgttggattcatggccggatttcaaagctgttatcacccgacgacaaagagaggctgagacagataaccttgatcattatactaatgcctatgctgtgttctacaaggatgtcagggcttatcgacagctattggaagaatgtgatgtttttaactgggaccaagtttttcaaatacaagggctgcagagtgagttatatgatgtttccaaagcggttgccaattcaaagcagttgaatataaagctaacttccttcaaggctgttcatttttctcctgtttcatctctgccagataccagtttcctcaaggggccttccccacgactaacctacctgagtgttgccaatgcggatctactcaaccggacttggtcccggggaggcaatgaacaatgtctccggtacatcgccaacctcatctcctgcttccctagtgtgtgtgtccgggatgagaagggaaacccggtctcctggtccatcacagaccagtttgccaccatgtgccatggctacaccctgccagaacatcgcaggaaaggttacagccggctggtggccctcacgctggccaggaagttgcaaagccggggattcccctctcaggggaacgtcctggatgacaacacggcgtctataagcctcctgaagagtctccatgctgagttcttgccttgtcgcttccacaggcttattctcacccctgcgactttctctggcctgcctcacctctagcccagtaaaaaactgcagtggttttattactttccctgagcatacacacactcttggctgccaacgaggggagagttaaaatgggaatcaggggactcttgagttgttggaaagggtctggagaatatataca

SEQ ID NO: 2648 - DNA, 571 bp, Homo sapiens
ataaaagggctactggactgatacacagctgaaaaccctcagttctggactgaactcccagcagtttctaattaggtgtggagttgcaagagctctggaaaagatgttggtgctaaactgttctaccaaattactgatactggagaaaatgttgaagagttgctttcctgaatcactcaaggtttacggagcggtgatgaacataaatcgtgggaacccctttcaaaaggaagtggtgttggattcatggccggatttcaaagctgttatcacccgacgacaaagagaggctgagacagataaccttgatcattatactaatgcctatgctgtgttctacaaggatgtcagggcttatcgacagctattggaagaatgtgatgtttttaactgggaccaagtttttcaaatacaagggctgcagagtgagttatatgatgtttccaaagcggttgccaattcaaagcagttgaatataaagctaacttccttcaaggctgttcatttttctcctgtttcatctctgccagataccagtttcctcaaggggccttccccacgactaacctac

SEQ ID NO: 2649 - DNA, 2862 bp, Homo sapiens
ttgaatctagtaaatgtggaatcacaaaattgaaataatgtgcatctgaaaagtgaataaatagatgccaagaaggagtgagtcataagcacatgagttgtaagaggttgaacttgagagaccagatcaggcagtgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaa

SEQ ID NO: 2650 - DNA, 2763 bp, Homo sapiens
tgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaactactctaaaatcttatgattcaaacaccccaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagaca

SEQ ID NO: 2651 - DNA, 1673 bp, Homo sapiens
ccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggttggcttttacaaacccctaagcttcttctttacctttccttaaaatttcaaccttctcttttcttactctataattgagaatgataacacagagagttaataacagtcaccctgctaactttccttagcatgagtgaacagtgagagataaaaatgaaatcttggttaaccttgccaaatctccaggacaccgaagagttaaaaagagagaaaaacaaaaagattaagctctttttcaaaaaaacaaaaccacttaatttttttctacctaaaaccataacaagaaaaaatgctaacacttatttatttgaatggcacatggagaccgggcatgtggctcacacttgtaatcccagcaccttggaaggcggaggcgggtggatcacctgaagtcaggagttcaagaccagcctggccaacatggtgaagtcccgtccctactaaaaatacaaaaattagccaggtgtggtggtgcgcacctgtaatcccagctactcaggaggctgaggcaggagaatcacttgaatccgggaggtggaggttgcagtgagaggagattgagccattgcactccagcctgggcaacagagtgagactccatctcgaaaaacaaacaaacaaacaaaaaacagaatggcacattgatgagcattcattgattgattctttagtttttttatgttctctaaagaatttttaagatttaaagaagcatgtgctatttatttgtaggaaatcctcagaaaaggtacaaataaaaaataaaaattatccataattaataccagagattataattgttaattattatggtgttttctttgctagtatttaagatcattattaagatcacatacacatttttgcttactatcattagcatttgatgatatgatttttttaatttttatacattgttttaatggctgcacgatatttcattgtgtacaaataaaataactactgttccgctttgaccta

SEQ ID NO: 2652 - DNA, 2409 bp, Homo sapiens
tgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaactactctaaaatcttatgattcaaacaccccaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagag

SEQ ID NO: 2653 - DNA, 1994 bp, Homo sapiens
agagaccagatcaggcagtgccgcttaataccatcacatgatcctccccgaggccctgtatttaattaaaatagagagggaggcaccacagatgccagaagaacactgttgctcttggtggacgggcccagaggaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaactactctaaaatcttatgattcaaacaccccaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttata

SEQ ID NO: 2654 - DNA, 2155 bp, Homo sapiens
agaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaactactctaaaatcttatgattcaaacaccccaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcag

SEQ ID NO: 2655 - DNA, 1879 bp, Homo sapiens
agaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccag

SEQ ID NO: 2656 - DNA, 2802 bp, Homo sapiens
ctacccctttgtgagcagtctaggactttgtacacttgttaagtagggagaaggcaggggaggtggctggtttaaggggaacttgagggaagtagggaagactcctcttgggacctttggagtaggtgacacatgagcccagccccagctcacctgccaatccagctgaggagctcacctgccaatccagctgaggctgggcagaggtgggtgagaagagggaaaattgcagggacctccagttgggccaggccagaagctgctgtagctttaaccagacagctcagacctgtctggaggctgccagtgacaggttaggtttagggcagagaagaagcaagaccatggtggggaagatgtggcctgtgttgtggacactctgtgcagtcagggtgaccgtcgatgccatctctgtggaaactccgcaggacgttcttcgggcttcgcagggaaagagtgtcaccctgccctgcacctaccacacttccacctccagtcgagagggacttattcaatgggataagctcctcctcactcatacggaaagggtggtcatctggccgttttcaaacaaaaactacatccatggtgagctttataagaatcgcgtcagcatatccaacaatgctgagcagtccgatgcctccatcaccattgatcagctgaccatggctgacaacggcacctacgagtgttctgtctcgctgatgtcagacctggagggcaacaccaagtcacgtgtccgcctgttggtcctcgtgccaccctccaaaccagaatgcggcatcgagggagagaccataattgggaacaacatccagctgacctgccaatcaaaggagggctcaccaacccctcagtacagctggaagaggtacaacatcctgaatcaggagcagcccctggcccagccagcctcaggtcagcctgtctccctgaagaatatctccacagacacatcgggttactacatctgtacctccagcaatgaggaggggacgcagttctgcaacatcacggtggccgtcagatctccctccatgaacgtggccctgtatgtgggcatcgcggtgggcgtggttgcagccctcattatcattggcatcatcatctactgctgctgctgccgagggaaggacgacaacactgaagacaaggaggatgcaaggccgaaccgggaagcctatgaggagccaccagagcagctaagagaactttccagagagagggaggaggaggatgactacaggcaagaagagcagaggagcactgggcgtgaatccccggaccacctcgaccagtgacaggccagcagcagagggcggcggaggaagggttaggggttcattctcccgcttcctggcctcccttctcctttctaagccctgttctcctgtccctccatcccagacattgatggggacatttcttccccagtgtcagctgtggggaacatggctggcctggtaagggggtccctgtgctgatcctgctgacctcactgtcctgtgaagtaacccctcctggctgtgacacctggtgcgggcctggccctcactcaagaccaggctgcagcctccacttccctcgtagttggcaggagctcctggaagcacagcgctgagcatggggcgctcccactcagaactctccagggaggcgatgccagccttggggggtgggggctgtcctgctcacctgtgtgcccagcacctggaggggcaccaggtggagggtttgcactccacacatctttcttgaatgaatgaaagaataagtgagtatgcttgggccctgcattggcctggcctccagctcccactccctttccaacctcacttcccgtagctgccagtatgttccaaaccctcctgggaaggccacctcccactcctgctgcacaggccctggggagcttttgcccacacactttccatctctgcctgtcaatatcgtacctgtccctccaggcccatctcaaatcacaaggatttctctaaccctatcctaattgtccacatacgtggaaacaatcctgttactctgtcccacgtccaatcatgggccacaaggcacagtcttctgagcgagtgctctcactgtattagagcgccagctccttggggcagggcctgggcctcatggcttttgctttccctgaagccctagtagctggcgcccatcctagtgggcacttaagcttaattggggaaactgctttgattggttgtgccttcccttctctggtctccttgagatgatcgtagacacagggatgattcccacccaaacccacgtattcattcagtgagttaaacacgaattgatttaaagtgaacacacacaagggagcttgcttgcagatggtctgagttcttgtgtcctggtaattcctctccaggccagaataattggcatgtctcctcaacccacatggggttcctggttgttcctgcatcccgatacctcagccctggccctgcccagcccatttgggctctggttttctggtggggctgtcctgctgccctcccacagcctccttctgtttgtcgagcatttcttctactcttgagagctcaggcagcgttagggctgcttaggtctcatggaccagtggctggtctcacccaactgcagtttactattgctatcttttctggatgatcagaaaaataattccataaatctattgtctacttgcgattttttaaaaaatgtatatttttatatatattgttaaatcctttgcttcattccaaatgctttcagtaataataaaattgtgggtggaaattctta

SEQ ID NO: 2657 - DNA, 3493 bp, Homo sapiens
agttactttggagtgcagaaccatttcagacatgctgagggggactctactgtgcgcggtgctcgggcttctgcgcgcccagcccttcccctgtccgccagcttgcaagtgtgtcttccgggacgccgcgcagtgctcggggggcgacgtggcgcgcatctccgcgctaggcctgcccaccaacctcacgcacatcctgctcttcggaatgggccgcggcgtcctgcagagccagagcttcagcggcatgaccgtcctgcagcgcctcatgatctccgacagccacatttccgccgttgcccccggcaccttcagtgacctgataaaactgaaaaccctgaggctgtcgcgcaacaaaatcacgcatcttccaggtgcgctgctggataagatggtgctcctggagcagttgtttttggaccacaatgcgctaaggggcattgaccaaaacatgtttcagaaactggttaacctgcaggagctcgctctgaaccagaatcagctcgatttccttcctgccagtctcttcacgaatctggagaacctgaagttgttggatttatcgggaaacaacctgacccacctgcccaaggggttgcttggagcacaggctaagctcgagagacttctgctccactcgaaccgccttgtgtctctggattcggggctgttgaacagcctgggcgccctgacggagctgcagttccaccgaaatcacatccgttccatcgcacccggggccttcgaccggctcccaaacctcagttctttgacgctttcgagaaaccaccttgcgtttctcccctctgcgctctttcttcattcgcacaatctgactctgttgactctgttcgagaacccgctggcagagctcccgggggtgctcttcggggagatggggggcctgcaggagctgtggctgaaccgcacccagctgcgcaccctgcccgccgccgccttccgcaacctgagccgcctgcggtacttaggggtgactctgagcccgcggctgagcgcgcttccgcagggcgccttccagggccttggcgagctccaggtgctcgccctgcactccaacggcctgaccgccctccccgacggcttgctgcgcggcctcggcaagctgcgccaggtgtccctgcgccgcaacaggctgcgcgccctgccccgtgccctcttccgcaatctcagcagcctggagagcgtccagctcgaccacaaccagctggagaccctgcctggcgacgtgtttggggctctgccccggctgacggaggtcctgttggggcacaactcctggcgctgcgactgtggcctggggcccttcctggggtggctgcggcagcacctaggcctcgtgggcggggaagagcccccacggtgcgcaggccctggggcgcacgccggcctgccgctctgggccctgccggggggtgacgcggagtgcccgggcccccggggcccgcctccccgccccgctgcggacagctcctcggaagcccctgtccacccagccttggctcccaacagctcagaaccctgggtgtgggcccagccggtgaccacgggcaaaggtcaagatcatagtccgttctgggggttttattttctgcttttagctgttcaggccatgatcaccgtgatcatcgtgtttgctatgattaaaattggccaactctttcgaaaattaatcagagagagagcccttgggtaaaccaatgggaaaatcttctaattacttagaacctgaccagatgtggctcggaggggaatccagacccgctgctgtcttgctctccctcccctccccactcctcctctcttcttcctcttctctctcactgccacgccttcctttccctcctcctccccctctccgctctgtgctcttcattctcacaggcccgcaacccctcctctctgtgtcccccgcccgttcctggaaactgagcttgacgtttgtaaactgtggttgcctgccttccccagctcccacgcgggtgtgcgctgacactgccgggggcgctggactgtgttggacccatccgtgctccgctgtgcctggcttggcgtctggtggagagaggggcctcttcagtgtctactgagtaaggggacagctccaggccggggcctgtctcctgcacagagtaagccggtaaatgtttgtgaaatcaatgcgtggataaaggaacacatgccatccaagtgatgatggcttttcctggagggaaaggataggctgttgctctatctaattttttgtttttgtttttggacagtctagctctgtggcccaggctggcgtgcagtgggccgtctcagttcactgcagcctccgcctcccaggttcaagtgattctcatgcctcagcgttctgagtagctgggattagaggcgtgtgccactacacccggctaatttttgtactttttaaagtagagacggggctttgccatattggcctggctgatctcaaactcctggtcttgaactcctggccacaagtgatctgcccgccttggcctcccaaagtgctgggattacaggcgtaagccactacacctggccctcttcatcgaattttatttgagaagtagagctcttgccattttttcccttgctccatttttctcactttatgtctctctgacctatgggctacttgggagagcactggactccattcatgcatgagcattttcaggataagcgacttctgtgaggctgagagaggaagaaaacacggagccttccctccaggtgcccagtgtaggtccagcgtgtttcctgagcctcctgtgagtttccacttgctttacatccatgcaacatgtcattttgaaactggattgatttgcatttcctggaactctgccacctcatttcacaagcatttatggagcagttaacatgtgactggtattcatgaatataatgataagcttgattctagttcagctgctgtcacagtctcatttgttcttccaactgaaagccgtaaaacctttgttgctttaattgaatgtctgtgcttatgagaggcagtggttaaaacaggggctggcgagttgacaactgtgggttcaaatcccagctctaccacttactaactgcatgggactttgggtaagacacctgcttacattctctaagccttggtttcctgaaccttaaaacaggataacatagtacctgcttcgtagagtttttgtgagaattaaaggcaataaagcatataatgacttagcccagcggcctgcaggcaatacatgttaatgaatgttagctattattactaaaggatgagcaattattattggcatcatgatttctaaagaagagctttgagttggtatttttctctgtgtataagggtaagtccgaactttctcagactggaggttacattcacatcagtctgtcttcccctgcggatggcctcagccctgggtggccagactctgtgctcacaatccagagcaatggatcc

SEQ ID NO: 2658 - DNA, 3534 bp, Homo sapiens
ggatcccagggttcagtacaggcgcgaacgctcctgtgtgttgaccacactcccacggttgctttttcagacatgctgagggggactctactgtgcgcggtgctcgggcttctgcgcgcccagcccttcccctgtccgccagcttgcaagtgtgtcttccgggacgccgcgcagtgctcggggggcgacgtggcgcgcatctccgcgctaggcctgcccaccaacctcacgcacatcctgctcttcggaatgggccgcggcgtcctgcagagccagagcttcagcggcatgaccgtcctgcagcgcctcatgatctccgacagccacatttccgccgttgcccccggcaccttcagtgacctgataaaactgaaaaccctgaggctgtcgcgcaacaaaatcacgcatcttccaggtgcgctgctggataagatggtgctcctggagcagttgtttttggaccacaatgcgctaaggggcattgaccaaaacatgtttcagaaactggttaacctgcaggagctcgctctgaaccagaatcagctcgatttccttcctgccagtctcttcacgaatctggagaacctgaagttgttggatttatcgggaaacaacctgacccacctgcccaaggggttgcttggagcacaggctaagctcgagagacttctgctccactcgaaccgccttgtgtctctggattcggggctgttgaacagcctgggcgccctgacggagctgcagttccaccgaaatcacatccgttccatcgcacccggggccttcgaccggctcccaaacctcagttctttgacgctttcgagaaaccaccttgcgtttctcccctctgcgctctttcttcattcgcacaatctgactctgttgactctgttcgagaacccgctggcagagctcccgggggtgctcttcggggagatggggggcctgcaggagctgtggctgaaccgcacccagctgcgcaccctgcccgccgccgccttccgcaacctgagccgcctgcggtacttaggggtgactctgagcccgcggctgagcgcgcttccgcagggcgccttccagggccttggcgagctccaggtgctcgccctgcactccaacggcctgaccgccctccccgacggcttgctgcgcggcctcggcaagctgcgccaggtgtccctgcgccgcaacaggctgcgcgccctgccccgtgccctcttccgcaatctcagcagcctggagagcgtccagctcgaccacaaccagctggagaccctgcctggcgacgtgtttggggctctgccccggctgacggaggtcctgttggggcacaactcctggcgctgcgactgtggcctggggcccttcctggggtggctgcggcagcacctaggcctcgtgggcggggaagagcccccacggtgcgcaggccctggggcgcacgccggcctgccgctctgggccctgccggggggtgacgcggagtgcccgggcccccggggcccgcctccccgccccgctgcggacagctcctcggaagcccctgtccacccagccttggctcccaacagctcagaaccctgggtgtgggcccagccggtgaccacgggcaaaggtcaagatcatagtccgttctgggggttttattttctgcttttagctgttcaggccatgatcaccgtgatcatcgtgtttgctatgattaaaattggccaactctttcgaaaattaatcagagagagagcccttgggtaaaccaatgggaaaatcttctaattacttagaacctgaccagatgtggctcggaggggaatccagacccgctgctgtcttgctctccctcccctccccactcctcctctcttcttcctcttctctctcactgccacgccttcctttccctcctcctccccctctccgctctgtgctcttcattctcacaggcccgcaacccctcctctctgtgtcccccgcccgttcctggaaactgagcttgacgtttgtaaactgtggttgcctgccttccccagctcccacgcgggtgtgcgctgacactgccgggggcgctggactgtgttggacccatccgtgctccgctgtgcctggcttggcgtctggtggagagaggggcctcttcagtgtctactgagtaaggggacagctccaggccggggcctgtctcctgcacagagtaagccggtaaatgtttgtgaaatcaatgcgtggataaaggaacacatgccatccaagtgatgatggcttttcctggagggaaaggataggctgttgctctatctaattttttgtttttgtttttggacagtctagctctgtggcccaggctggcgtgcagtgggccgtctcagttcactgcagcctccgcctcccaggttcaagtgattctcatgcctcagcgttctgagtagctgggattagaggcgtgtgccactacacccggctaatttttgtactttttaaagtagagacggggctttgccatattggcctggctgatctcaaactcctggtcttgaactcctggccacaagtgatctgcccgccttggcctcccaaagtgctgggattacaggcgtaagccactacacctggccctcttcatcgaattttatttgagaagtagagctcttgccattttttcccttgctccatttttctcactttatgtctctctgacctatgggctacttgggagagcactggactccattcatgcatgagcattttcaggataagcgacttctgtgaggctgagagaggaagaaaacacggagccttccctccaggtgcccagtgtaggtccagcgtgtttcctgagcctcctgtgagtttccacttgctttacatccatgcaacatgtcattttgaaactggattgatttgcatttcctggaactctgccacctcatttcacaagcatttatggagcagttaacatgtgactggtattcatgaatataatgataagcttgattctagttcagctgctgtcacagtctcatttgttcttccaactgaaagccgtaaaacctttgttgctttaattgaatgtctgtgcttatgagaggcagtggttaaaacaggggctggcgagttgacaactgtgggttcaaatcccagctctaccacttactaactgcatgggactttgggtaagacacctgcttacattctctaagccttggtttcctgaaccttaaaacaggataacatagtacctgcttcgtagagtttttgtgagaattaaaggcaataaagcatataatgacttagcccagcggcctgcaggcaatacatgttaatgaatgttagctattattactaaaggatgagcaattattattggcatcatgatttctaaagaagagctttgagttggtatttttctctgtgtataagggtaagtccgaactttctcagactggaggttacattcacatcagtctgtcttcccctgcggatggcctcagccctgggtggccagactctgtgctcacaatccagagcaatggatcc

SEQ ID NO: 2659 - DNA, 3593 bp, Homo sapiens
acgcgtggcgcgatggcggcggccccacgcgcgggccggcggcgcgggcagccgctcctggcgctgctgcttctgctgctggcgccactgccgccgggggccccgccgggcgccgacgcctacttccccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatgggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcagaggttcagatgtatgtgtgcaacaaggaggagtacggattcttgccagtgccattgcgcgcccacagcaccctccaggatgaggccgagagcttcatgcatgtgcagctggaggtcatggtgaagcacccgcccgcagagccctcccgcttcatctcggctcccaccaagacaccggacaagatgggcttcgacgaggtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctactggaccctggcctacgtgatctccctgcaaggcgcccgcaaactgctggctgctgagccgctctccaagatgctgcctgtggacgagttcctgcccgtcatgttcgacaaacacccagtgtccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctgaggggtagcagccagaaagccaaagcagccatcggtggcccaggctccacgtgcttactgaggacatcaggtccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggatttttttttttttttttttaagagtagagtctgtctctgtcacccaggctggagtgcagtggtgtgacggctcactgcagcctgcgcctcccagcgtccagcaattcttgtttctcggcctcccaagtagctgggactataggtgcgtgccatcacatctggctagtttttgtatttttagtagagacggggtttcaccatgttggccaggctggtctcgaactcctgacctcaagtgatctgcccgccttggccacccaaagtgctagggttacaggcatgagccactgtgcccagcccaggctctgggaatattgagataaataagatgcttctatccatttattcaagcacatattggtcacctactgtgtgcctggcactcatgtcacaaagataagttcctgattcggtacacttactgagcacctgctgtgtgcagggagctgagctatgggatgggaatgggagtaaacaaggtactttttacttttttctttttttcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcagacaacatccccccaccacccaagagggagggtagctcttccgccaccaggggcaagcacaggtcctggtggccccacgccacatgttagcccccctggagggggcgccagttggagacgggggctgggtgtccctggcccactcccggtcccctgtgctttacctccttgcccttgtgtctcaggtgtggtccctgcctgcttgatgaagttgctctgttcaagcctttggtgggatcatgtgtttgggggcttttaggggacccagctgcactggggcactgcccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttttc

SEQ ID NO: 2660 - DNA, 1461 bp, Homo sapiens
cccctttaaggcgcggccagagtcctcccgcagaaaaacgacttaaaggagacgcgtggcgcgatggcggcggccccacgcgcgggccggcggcgcgggcagccgctcctggcgctgctgcttctgctgctggcgccactgccgccgggggccccgccgggcgccgacgcctacttccccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatgggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcagtgaagcacccgcccgcagagccctcccgcttcatctcggctcccaccaagacaccggacaagatgggcttcgacgaggtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctactggacagtgctgcccgggatgaactctgaggggtag

SEQ ID NO: 2661 - DNA, 5177 bp, Homo sapiens
cacaactcgcggctctagggaaggccacagacctcagctgtacgagcggaacctggactagaggaactttcctcaggactcagggcacacagcccctcggccactactgtctgcgagcccgaggcgcaggggagcgccagcggctgcaggtacgctgcgcacccgcactggggcctgggcggtgcagcggcggcgggagggtcctgggaaccgcagccgccgaggccagtgtgtgagccggccggccgcggcaagccgcatcccccggccgcccctcgcagccccttgctccccggcagccgccgccgccctcaggcagcccagccgggcgctcgcgccaggacttccccgccgcccgcctcggcccggaacatggctgcgcgccctgctgccaccctcgcctggtcgctactgctcctctcctcagccctgctccgcgaaggctgccgagcgcgcttcgtcgccgagcgggactcggaggacgacggagaggagccggtggttttcccggagtcgcccctgcagagccccacggtgctcgtggcggtcctcgcccgcaacgcggcgcacacgctgccgcacttcctcggctgcctggagcggctggactaccccaagagcaggatggccatctgggcagccactgatcacaatgtggataatacaacagaaatattcagggagtggttgaaaaatgtacagagactctatcactatgtggagtggaggcctatggatgaaccagagtcttaccctgatgaaattggaccaaagcactggccaacctcccggtttgcccatgtgatgaaactacgacaggcagcccttcgaactgcgagggaaaaatggtcagactacattctgttcatagatgttgacaatttcctgactaatccacagaccctcaatctactgattgcagaaaacaaaactattgtggcccccatgctggagtctcggggcctgtattctaatttctggtgcggaatcacccctaagggcttctataagaggaccccagactacgttcagattcgagaatggaagaggacaggctgcttccccgtccccatggtccactccaccttcctaattgacctcaggaaggaggcctcggacaagctgactttctaccccccacaccaggactacacctggacctttgatgacatcattgtctttgccttctccagcaggcaagcaggcatccagatgtacctctgcaacagagagcactatggctacctgcccatccccctgaagccccatcagacactgcaggaagacatcgagaacctcatccatgtgcagattgaagcaatgattgaccgtcctccaatggaaccctcccagtatgtctcagttgtccctaaatatccagacaagatgggatttgatgagattttcatgataaacctcaaacgcagaaaggacaggcgggaccggatgctgcgcacactgtatgaacaggagattgaggtcaagattgtcgaggctgtggatggaaaggcactcaacacaagccagctgaaggcactgaatattgaaatgctgcctggctatcgagatccctattcctccaggcctctaacaaggggtgaaatcggctgctttctcagccactactcagtctggaaagaggtaattgatcgagagctagagaagactcttgtaattgaagacgatgtgcgttttgagcatcagtttaagaagaagctgatgaagctgatggataacattgaccaggctcagctggactgggaactgatttatattggtaggaagaggatgcaagtaaaggagccagagaaagcagtgcccaatgtggcaaacctggtcgaagccgactattcctactggaccctgggctacgtcatctctctggaaggagcacagaagctggttggagccaatccttttgggaagatgctgccagtggatgagtttctgccagtcatgtacaacaagcatcccgtagccgagtacaaggagtattatgaatccagggacctgaaagccttctctgcagaacccttgctcatctaccctacgcactacacaggccagccggggtacctgagtgacacggagacctccaccatctgggacaatgagacagtggccaccgactgggataggacacatgcctggaagtcccggaagcaaagccgcatctacagcaatgccaagaacacagaggccctgccaccgccaacctccctggacactgtgccttcaagggatgagctatgaaggctccctgggagtgtggcccacatcagttcaacatcctctggtttttctaaagggctattcatctgtttgctccagttttctgttttgttttgttcttagtggtcacagtcatctaaccaaagtgatctagtgtgatagatcgaaattaacatatttttgaccatggaaggaaataaggaaattcaacccaaatttcccaagacggctgaaagacaggttttttggaaactgttaagataaactgtaatccagacacctaattcttcagttcactactcatgtgatactgattcccacattaaggttgaacaacatggctcagagtcttgttcaagagaaagtgatcaccgagctgtcacatcagcaaatatgtagtcaaggcagccaggccaactagaccacacttattggtctagtttgtccgttttatatgacattgaaaacttgtgtgtgcaacttttgggggacaggaatcacttaaaatcatatttatttggctttttatttaaaggattctgtcacaagtcttattgaaaagtagattttttaaaaaaaaaaaatcttagtccctgttatccagtaggggtgggtatttgggtccgactgagacttggcctgtgaccatcatggcagttggagttctcatatagaggtgaccagtttgccatgtggatataatttagtagatatttgacagtttgtgtaggtatttgagggaaaaaactcaatgtttggcttttttattatggccactcgagtcaggatgctctatttataaagataaatgtaatatataaagggtgaggactggctgtgcatcctgccctgtcccgggtttgcgcgctgctacagagcttcacgctctccgctccaccccttagcctgggaacccaccgcaggtgtgagttctgtgagtcactgctaagagacagagcacattttcaggccagcaactatccttgccagagttttttcattatattttgaattatttattttacaaaatgggcgaagatattgtctttaggataaggcagagaaacagatgttgcagacttccacggcacccgggggagtggtgggtgtggacacattggttcggcaatctgattctcctgaatttcccagccaggctcttgtggggaggcctgtggatggggggatttgaactatttggaaacaaatgattctctatctcaggtgagaaacctggtcagaaacaaagggctggtcacctgatttaggccagcaaccagggaagctcttagaatcccaggcggacaccctttctcaaaagatatcccctaagagtcctttctgctttcttcacagattgattttatgtaaaatgcagagttggactacacgatttcttcccactccacaatctgtcatcctagtatagatcatggtggtttccctcaagtttatgttctcatgccctcaatctgtaaatttttgtctccagaaaaaccctcccaggcatcccataccagcaccgttcctcatcactgtccatgcaccatgcagccatatggggggccgtgcacaccccaaaccctgagcttcacacttaaactcatggggagggcccttcagagcagagtccacaggcgggtggtgctacatacacaagcttagtgtacgagtgtaagatacactttaagccagacacctaattcttcagttcactgcccatgtgatactgattgccacattaaggttgaacagcatggctcagagtctagagaaagtgatcaccaagctgtctcatcaccaaataggtagtcaaggcagcctcatctccccaggtgaggggcgggtccccactttaggacaagaggcagcttgccttccaccagacgccagcctcggccttccttcccgactcactgtgggtacccttctacactgaccagcaagctaggccgctggaggaaagggaactcacccaactctaaattgtgccgcttagacttagctgtcagtgtgacttcctttcccacccacccccagaaaaacagaaagagcatctggggagcgagtgaaaattccttaggtgattcctaagatttccttgggtatctggtttttgttttcatatttgagtgtgtgcatgtgtgcatgactttaatgacttttttaatggggtgggaggtggctggggtgctggggttgaaggaagtttgggttgatttttgtggtgttttgtttaatagagaattttttttttcctgttcccctgtcagctggtctgacagatttaagaactctcattcttaaaagactttggacttaaattctagcattttagactaggactgttctactgtgaagaaagttctgtctcctttagcccggtttgtttctccctgctcaggtctagaatcccaagcagtgttcttttctggtgaacactgtgagccgcagatgtgactttttttttaaagtcatctcttcagcaatccagaggttccttgacctcattatttgtcctatctctcccttatagtcctaagccaagacatttgacctttgacatttgacctttgcagtgtcatgtgagggcgtcagtatagaggcctttgcatctgggcctggcacccgctctctgcctctggaggctaaaccctgtctggatttctcttgggatctaacgtgggatcttctggacagacaaccgtgacatcagcagtgctggtgctgctgtgtgtggactgaacacctgcactttgcagaggacacgctgcatgggccccgcttgcggttcattcaggcctgctgcaggagctctgagaacaagaaagagtggacacccgttcccctgcatcatctgtcttgcgtgctatttcagagtggggaagtgataaactatttgccttctggagctctttgtgaaaaattaaaaaaaaacttagctc

SEQ ID NO: 2662 - DNA, 2325 bp, Homo sapiens
ttttcgtttttttgttctatgtatgcctagatttagctttaataatctgtcagcgttacagaattttcctgtttgctttcatatcaaatgtggatttcattcctcattttcttgttatttcctgtaggtggattacagtgttccattctgctctccagaatgggaattccttgcctcccttttgatcctttcatgccttttttgttcattccaggccatgagtttgctttttcttcagagggaaaaaatcaatttcctctgggctgaagaatagccgagtgtttttattagtccccaatgctgtgttttacttttttaataaaggagcattttttaggtctatagacatacctgaaacaaccacttatttaattgcagtgtcaaactcagcatcagacacagttcaggttccttctcctcgcttgtcactcagcagtatgttttctgattgttggctttgtccctctcttggatcctcaggcatccagatgtacctctgcaacagagagcactatggctacctgcccatccccctgaagccccatcagacactgcaggaagacatcgagaacctcatccatgtgcagattgaagcaatgattgaccgtcctccaatggaaccctcccagtatgtctcagttgtccctaaatatccagacaagatgggatttgatgagattttcatgataaacctcaaacgcagaaaggacaggcgggaccggatgctgcgcacactgtatgaacaggagattgaggtcaagattgtcgaggctgtggatggaaaggcactcaacacaagccagctgaaggcactgaatattgaaatgctgcctggctatcgagatccctattcctccaggcctctaacaaggggtgaaatcggctgctttctcagccactactcagtctggaaagaggtaattgatcgagagctagagaagactcttgtaattgaagacgatgtgcgttttgagcatcagtttaagaagaagctgatgaagctgatggataacattgaccaggctcagctggactgggaactgatttatattggtaggaagaggatgcaagtaaaggagccagagaaagcagtgcccaatgtggcaaacctggtcgaagccgactattcctactggaccctgggctacgtcatctctctggaaggagcacagaagctggttggagccaatccttttgggaagatgctgccagtggatgagtttctgccagtcatgtacaacaagcatcccgtagccgagtacaaggagtattatgaatccagggacctgaaagccttctctgcagaacccttgctcatctaccctacgcactacacaggccagccggggtacctgagtgacacggagacctccaccatctgggacaatgagacagtggccaccgactgggataggacacatgcctggaagtcccggaagcaaagccgcatctacagcaatgccaagaacacagaggccctgccaccgccaacctccctggacactgtgccttcaagggatgagctatgaaggctccctgggagtgtggcccacatcagttcaacatcctctggtttttctaaagggctattcatctgtttgctccagttttctgttttgttttgttcttagtggtcacagtcatctaaccaaagtgatctagtgtgatagatcgaaattaacatatttttgaccatggaaggaaataaggaaattcaacccaaatttcccaagacggctgaaagacaggttttttggaaactgttaagataaactgtaatccagacacctaattcttcagttcactactcatgtgatactgattcccacattaaggttgaacaacatggctcagagtcttgttcaagagaaagtgatcaccgagctgtcacatcagcaaatatgtagtcaaggcagccaggccaactagaccacacttattggtctagtttgtccgttttatatgacattgaaaacttgtgtgtgcaacttttgggggacaggaatcacttaaaatcatatttatttggctttttatttaaaggattctgtcacaagtcttattgaaaagtagattttttaaaaaaaaaaaatcttagtccctgttatccagtaggggtgggtatttgggtccgactgagacttggcctgtgaccatcatggcagttggagttctcatatagaggtgaccagtttgccatgtggatataatttagtagatatttgacagtttgtgtaggtatttgagggaaaaaactcaatgtttggcttttttattatggccactcgagtcaggatgctctatttataaagataaatgtaatat

SEQ ID NO: 2663 - DNA, 4723 bp, Homo sapiens
ttttctattcttttactttcaacctatttttgtcttttaatctaaaggctgcctcttatagataccacatggttgtattaatttttaaaacttactatgccaaattcttccttcattgcagtgttttattcatttgccttcactacatttttttccagatccttaaggtcagccagaggtgagagactagggacttctcaagtttttcctgggcgtgtggacagccctgaatatgcctggggccttctagattctcagggatattttggagcaaatcaaactccctatggacctcttattccttggtttttccttttaagttttttggtgggcttcttgttagcatcagctgataatgcttctcaaacagctgtaatgttaaacagttgttgctcatgggttttgacaaatgacctgcagatagtgctgttcacagaaaatgaactctgagtcaggtcaaatcaagacaagctctgagaatgtagcttttcaaggagctactagacaggttgaatagagattattttctgggggcaggtctttaagggagtctcagtccattttgtccctgccagtggcttctgggttggtggggtttgccgctctcttagttgtgaggctactggttttcaaggcttttgtagggctggggtgaacaggttaggattagggcagctgtgaacttcacaaagctcactgtgttaacagagattcagcagtaggtcttgatcaaacactccttggattattgcagtactttaactaatttccataggagtgtacttattaaatcttgtcaaaaaactgatgatgcttagaactatgttgggcactatgagggatacacaaaaatatgataccctcttgtcttcccagacctcataatactagtgtgacacattagcctggaggaacttctaaggaataaagggaagcctctctgtctttgtctgtgtgggggaggggtgtttgcagaactaactctctctttctctggcctttgtggtggggacctttgacttgttaatctccagacgtgttttatgtgatgcagggcactcaacacaagccagctgaaggcactgaatattgaaatgctgcctggctatcgagatccctattcctccaggcctctaacaaggggtgaaatcggctgctttctcagccactactcagtctggaaagaggtaattgatcgagagctagagaagactcttgtaattgaagacgatgtgcgttttgagcatcagtttaagaagaagctgatgaagctgatggataacattgaccaggctcagctggactgggaactgatttatattggtaggaagaggatgcaagtaaaggagccagagaaagcagtgcccaatgtggcaaacctggtcgaagccgactattcctactggaccctgggctacgtcatctctctggaaggagcacagaagctggttggagccaatccttttgggaagatgctgccagtggatgagtttctgccagtcatgtacaacaagcatcccgtagccgagtacaaggagtattatgaatccagggacctgaaagccttctctgcagaacccttgctcatctaccctacgcactacacaggccagccggggtacctgagtgacacggagacctccaccatctgggacaatgagacagtggccaccgactgggataggacacatgcctggaagtcccggaagcaaagccgcatctacagcaatgccaagaacacagaggccctgccaccgccaacctccctggacactgtgccttcaagggatgagctatgaaggctccctgggagtgtggcccacatcagttcaacatcctctggtttttctaaagggctattcatctgtttgctccagttttctgttttgttttgttcttagtggtcacagtcatctaaccaaagtgatctagtgtgatagatcgaaattaacatatttttgaccatggaaggaaataaggaaattcaacccaaatttcccaagacggctgaaagacaggttttttggaaactgttaagataaactgtaatccagacacctaattcttcagttcactactcatgtgatactgattcccacattaaggttgaacaacatggctcagagtcttgttcaagagaaagtgatcaccgagctgtcacatcagcaaatatgtagtcaaggcagccaggccaactagaccacacttattggtctagtttgtccgttttatatgacattgaaaacttgtgtgtgcaacttttgggggacaggaatcacttaaaatcatatttatttggctttttatttaaaggattctgtcacaagtcttattgaaaagtagattttttaaaaaaaaaaaatcttagtccctgttatccagtaggggtgggtatttgggtccgactgagacttggcctgtgaccatcatggcagttggagttctcatatagaggtgaccagtttgccatgtggatataatttagtagatatttgacagtttgtgtaggtatttgagggaaaaaactcaatgtttggcttttttattatggccactcgagtcaggatgctctatttataaagataaatgtaatatataaagggtgaggactggctgtgcatcctgccctgtcccgggtttgcgcgctgctacagagcttcacgctctccgctccaccccttagcctgggaacccaccgcaggtgtgagttctgtgagtcactgctaagagacagagcacattttcaggccagcaactatccttgccagagttttttcattatattttgaattatttattttacaaaatgggcgaagatattgtctttaggataaggcagagaaacagatgttgcagacttccacggcacccgggggagtggtgggtgtggacacattggttcggcaatctgattctcctgaatttcccagccaggctcttgtggggaggcctgtggatggggggatttgaactatttggaaacaaatgattctctatctcaggtgagaaacctggtcagaaacaaagggctggtcacctgatttaggccagcaaccagggaagctcttagaatcccaggcggacaccctttctcaaaagatatcccctaagagtcctttctgctttcttcacagattgattttatgtaaaatgcagagttggactacacgatttcttcccactccacaatctgtcatcctagtatagatcatggtggtttccctcaagtttatgttctcatgccctcaatctgtaaatttttgtctccagaaaaaccctcccaggcatcccataccagcaccgttcctcatcactgtccatgcaccatgcagccatatggggggccgtgcacaccccaaaccctgagcttcacacttaaactcatggggagggcccttcagagcagagtccacaggcgggtggtgctacatacacaagcttagtgtacgagtgtaagatacactttaagccagacacctaattcttcagttcactgcccatgtgatactgattgccacattaaggttgaacagcatggctcagagtctagagaaagtgatcaccaagctgtctcatcaccaaataggtagtcaaggcagcctcatctccccaggtgaggggcgggtccccactttaggacaagaggcagcttgccttccaccagacgccagcctcggccttccttcccgactcactgtgggtacccttctacactgaccagcaagctaggccgctggaggaaagggaactcacccaactctaaattgtgccgcttagacttagctgtcagtgtgacttcctttcccacccacccccagaaaaacagaaagagcatctggggagcgagtgaaaattccttaggtgattcctaagatttccttgggtatctggtttttgttttcatatttgagtgtgtgcatgtgtgcatgactttaatgacttttttaatggggtgggaggtggctggggtgctggggttgaaggaagtttgggttgatttttgtggtgttttgtttaatagagaattttttttttcctgttcccctgtcagctggtctgacagatttaagaactctcattcttaaaagactttggacttaaattctagcattttagactaggactgttctactgtgaagaaagttctgtctcctttagcccggtttgtttctccctgctcaggtctagaatcccaagcagtgttcttttctggtgaacactgtgagccgcagatgtgactttttttttaaagtcatctcttcagcaatccagaggttccttgacctcattatttgtcctatctctcccttatagtcctaagccaagacatttgacctttgacatttgacctttgcagtgtcatgtgagggcgtcagtatagaggcctttgcatctgggcctggcacccgctctctgcctctggaggctaaaccctgtctggatttctcttgggatctaacgtgggatcttctggacagacaaccgtgacatcagcagtgctggtgctgctgtgtgtggactgaacacctgcactttgcagaggacacgctgcatgggccccgcttgcggttcattcaggcctgctgcaggagctctgagaacaagaaagagtggacacccgttcccctgcatcatctgtcttgcgtgctatttcagagtggggaagtgataaactatttgccttctggagctctttgtgaaaaattaaaaaaaaacttagctc

SEQ ID NO: 2664 - DNA, 2352 bp, Homo sapiens
aagccgcatcccccggccgcccctcgcagccccttgctccccggcagccgccgccgccctcaggcagcccagccgggcgctcgcgccaggacttccccgccgcccgcctcggcccggaacatggctgcgcgccctgctgccaccctcgcctggtcgctactgctcctctcctcagccctgctccgcgaaggctgccgagcgcgcttcgtcgccgagcgggactcggaggacgacggagaggagccggtggttttcccggagtcgcccctgcagagccccacggtgctcgtggcggtcctcgcccgcaacgcggcgcacacgctgccgcacttcctcggctgcctggagcggctggactaccccaagagcaggatggccatctgggcagccactgatcacaatgtggataatacaacagaaatattcagggagtggttgaaaaatgtacagagactctatcactatgtggagtggaggcctatggatgaaccagagtcttaccctgatgaaattggaccaaagcactggccaacctcccggtttgcccatgtgatgaaactacgacaggcagcccttcgaactgcgagggaaaaatggtcagactacattctgttcatagatgttgacaatttcctgactaatccacagaccctcaatctactgattgcagaaaacaaaactattgtggcccccatgctggagtctcggggcctgtattctaatttctggtgcggaatcacccctaagggcttctataagaggaccccagactacgttcagattcgagaatggaagaggacaggctgcttccccgtccccatggtccactccaccttcctaattgacctcaggaaggaggcctcggacaagctgactttctaccccccacaccaggactacacctggacctttgatgacatcattgtctttgccttctccagcaggcaagcaggcatccagatgtacctctgcaacagagagcactatggctacctgcccatccccctgaagccccatcagacactgcaggaagacatcgagaacctcatccatgtgcagattgaagcaatgattgaccgtcctccaatggaaccctcccagtatgtctcagttgtccctaaatatccagacaagatgggatttgatgagattttcatgataaacctcaaacgcagaaaggacaggcgggaccggatgctgcgcacactgtatgaacaggagattgaggtcaagattgtcgaggctgtggatggaaaggcactcaacacaagccagctgaaggcactgaatattgaaatgctgcctggctatcgagatccctattcctccaggcctctaacaaggggtgaaatcggctgctttctcagccactactcagtctggaaagaggtaattgatcgagagctagagaagactcttgtaattgaagacgatgtgcgttttgagcatcagtttaagaagaagctgatgaagctgatggataacattgaccaggctcagctggactgggaactgatttatattggtaggaagaggatgcaagtaaaggagccagagaaagcagtgcccaatgtggcaaacctggtcgaagccgactattcctactggaccctgggctacgtcatctctctggaaggagcacagaagctggttggagccaatccttttgggaagatgctgccagtggatgagtttctgccagtcatgtacaacaagcatcccgtcctcctctcaagtcctcactgccatctcttccaaacactttctgatgactgccaacggtgaacaaacccgtgcaccctaggagaaggcattacccctctgtggcagaggtggtcgtgttcatcaactcctccaggtttctcctgcatttcccacctcccctgtactcacatcgggcccggggactggttgatgggctgtgaacagaagtgacaggtgtcgctttggtctaaggcagttgggaacagtttgtgagttctctttactctctttatcatcactgtgactggaagggaaacaccgagatggcgaagttgcaagatggaagctgcctggatctgtgagctgctgttagagaaaagctactaaggagtttcctggcttgcattacactgtcccgtgaaagaaaaaataaacctcggtcttaagctgttgaaatttcttggtttgttacttcggtccagcctagcctagcctaacacatcccttccaaaggtatttaattttaagagagatgtctagggggaaaagcaatgcaaaatgcaatggaaataactttgcctagtggaaatgtaggcatctgaagaaaaagaggtttgagtcaggaacctcctcagtccccctgaaatc

SEQ ID NO: 2665 - DNA, 1880 bp, Homo sapiens
aagaaacccgagacgttccgaagtcaacgcaagcaaaggggagtgcgggtcggggaggaatattcttttggaaacgtaatattggccttggggctctccagccctttgggacttccaatgggatcttagaagcagccgaagcagcgtgagggcggcagcccagggccagccacgatttgaacgctctgccttgcagctcttctggaccgaggagcccaaagccctaccctcaccattcaccaggtcctgtgggaagagcagcgtggaggtgggctgaggttagaaggtgcagagcgtggaagaagattgtgagctgagtattggacatctgttcttgaatagtccctgggcctgccataggaaaggaagttctccagggttacagttcttatccgcgtgaatacacatggctctgttacgaaaaattaatcaggtgctgctgttccttctgatcgtgaccctctgtgtgattctgtataagaaagttcataaggggactgtgcccaagaatgacgcagatgatgaatccgagactcctgaagaactggaagaagagattcctgtggtgatttgtgctgcagcagggaggatgggtgccactatggctgccatcaatagcatctacagcaacactgacgccaacatcttgttctatgtagtgggactccggaatactctgactcgaatacgaaaatggattgaacattccaaactgagagaaataaactttaaaatcgtggaattcaacccgatggtcctcaaagggaagatcagaccagactcatcgaggcctgaattgctccagcctctgaactttgttcgattttatctccctctacttatccaccaacacgagaaagtcatctatttggacgatgatgtaattgtacaaggtgatatccaagaactgtatgacaccaccttggccctgggccacgcggcggctttctcagatgactgcgatttgccctctgctcaggacataaacagactcgtgggacttcagaacacatatatgggctatctggactaccggaagaaggccatcaaggaccttggcatcagccccagcacctgctctttcaatcctggtgtgattgttgccaacatgacagaatggaagcaccagcgcatcaccaagcaattggagaaatggatgcaaaagaatgtggaggaaaacctctatagcagctccctgggaggaggggtggccacctccccaatgctgattgtgtttcatgggaaatattccacaattaaccccctgtggcacataaggcacctgggctggaatccagatgccagatattcggagcattttctgcaggaagctaaattactccactggaatggaagacataaaccttgggacttccctagtgttcacaacgacttatgggaaagctggtttgttcctgaccctgcagggatatttaaactcaatcaccatagctgatataactctacccttaaaatattccctgtatagaaatgtggaattgtccctttgtagccaactataacattgttctttatgaatattacctttgatacatatgatccacaatataaaaaccaaaaactactgtgtgcaaattataccttggaccatataggcattgattaacttctttaagtacatgtgataactatggaaatcaagattatgtgactgaaaaacataaaggaagagacccatctagataacagcaatcaacctgcttaattctgaatgacaattatatccacaaatttttaaaacttctacatgtatttttcacatgaagatctccttaacaggttgccaaccttttcttttataaaactattacatttaaaatatggacgtctgaaaaataaaatattcatcatttttatga

SEQ ID NO: 2666 - DNA, 1578 bp, Homo sapiens
agagatggagttatttccctagaatcacacgatcataatggcttgtataagtggggttccaactgtttgccaagtactgttgttacagttcttatccgcgtgaatacacatggctctgttacgaaaaattaatcaggtgctgctgttccttctgatcgtgaccctctgtgtgattctgtataagaaagttcataaggggactgtgcccaagaatgacgcagatgatgaatccgagactcctgaagaactggaagaagagattcctgtggtgatttgtgctgcagcagggaggatgggtgccactatggctgccatcaatagcatctacagcaacactgacgccaacatcttgttctatgtagtgggactccggaatactctgactcgaatacgaaaatggattgaacattccaaactgagagaaataaactttaaaatcgtggaattcaacccgatggtcctcaaagggaagatcagaccagactcatcgaggcctgaattgctccagcctctgaactttgttcgattttatctccctctacttatccaccaacacgagaaagtcatctatttggacgatgatgtaattgtacaaggtgatatccaagaactgtatgacaccaccttggccctgggccacgcggcggctttctcagatgactgcgatttgccctctgctcaggacataaacagactcgtgggacttcagaacacatatatgggctatctggactaccggaagaaggccatcaaggaccttggcatcagccccagcacctgctctttcaatcctggtgtgattgttgccaacatgacagaatggaagcaccagcgcatcaccaagcaattggagaaatggatgcaaaagaatgtggaggaaaacctctatagcagctccctgggaggaggggtggccacctccccaatgctgattgtgtttcatgggaaatattccacaattaaccccctgtggcacataaggcacctgggctggaatccagatgccagatattcggagcattttctgcaggaagctaaattactccactggaatggaagacataaaccttgggacttccctagtgttcacaacgacttatgggaaagctggtttgttcctgaccctgcagggatatttaaactcaatcaccatagctgatataactctacccttaaaatattccctgtatagaaatgtggaattgtccctttgtagccaactataacattgttctttatgaatattacctttgatacatatgatccacaatataaaaaccaaaaactactgtgtgcaaattataccttggaccatataggcattgattaacttctttaagtacatgtgataactatggaaatcaagattatgtgactgaaaaacataaaggaagagacccatctagataacagcaatcaacctgcttaattctgaatgacaattatatccacaaatttttaaaacttctacatgtatttttcacatgaagatctccttaacaggttgccaaccttttcttttataaaactattacatttaaaatatggacgtctgaaaaataaaatattcatcatttt

SEQ ID NO: 2667 - DNA, 1835 bp, Homo sapiens
acaagcaacgtgagagaagctcgggtagaggttcgaagagctgggagcgcagggcggggacctcgcacgggagggtgcgggcgggagcctgcctcgcgagcccgggccacggcggctgctcccgaccgtgactgggacccgggcagggaaggtcgctacaaagcctgccgggcgaaccgaaggcagctttgtgcggagccatgccaggaagcttgggaaccgtgagccacaagagaacagcgttgttttttgcatgttttgcacttagccagaggaagtctggcgcatccgagccggccagccgagcacatctggaagtggtttctggggccgcccctctctgccagcgcaactcctgggttcccagcggcttcgcgcagaggtggaagaaacccgagacgttccgaagtcaacgcaagcaaaggggagtgcgggtcggggaggaatattcttttggaaacgtaatattggccttggggctctccagccctttgggacttccaatgggatcttagaagcagccgaagcagcgtgagggcggcagcccagggccagccacgatttgaacgctctgccttgcagctcttctggaccgaggagcccaaagccctaccctcaccattcaccaggttacagttcttatccgcgtgaatacacatggctctgttacgaaaaattaatcaggtgctgctgttccttctgatcgtgaccctctgtgtgattctgtataagaaagttcataaggggactgtgcccaagaatgacgcagatgatgaatccgagactcctgaagaactggaagaagagattcctgtggtgatttgtgctgcagcagggaggatgggtgccactatggctgccatcaatagcatctacagcaacactgacgccaacatcttgttctatgtagtgggactccggaatactctgactcgaatacgaaaatggattgaacattccaaactgagagaaataaactttaaaatcgtggaattcaacccgatggtcctcaaagggaagatcagaccagactcatcgaggcctgaattgctccagcctctgaactttgttcgattttatctccctctacttatccaccaacacgagaaagtcatctatttggacgatgatgtaattgtacaaggtgatatccaagaactgtatgacaccaccttggccctgggccacgcggcggctttctcagatgactgcgatttgccctctgctcaggacataaacagactcgtgggacttcagaacacatatatgggctatctggactaccggaagaaggccatcaaggaccttggcatcagccccagcacctgctctttcaatcctggtgtgattgttgccaacatgacagaatggaagcaccagcgcatcaccaagcaattggagaaatggatgcaaaagaatgtggaggaaaacctctatagcagctccctgggaggaggggtggccacctccccaatgctgattgtgtttcatgggaaatattccacaattaaccccctgtggcacataaggcacctgggctggaatccagatgccagatattcggagcattttctgcaggaagctaaattactccactggaatggaagacataaaccttgggacttccctagtgttcacaacgacttatgggaaagctggtttgttcctgaccctgcagggatatttaaactcaatcaccatagctgatataactctacccttaaaatattccctgtatagaaatgtggaattgtccctttgtagccaactataacattgttctttatgaatattacctttgatacatatgatccacaatataaaaaccaaaaact

SEQ ID NO: 2668 - DNA, 1714 bp, Homo sapiens
ttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggtggagtcttgctctgtcgccaggctggagtgcagtggcgcgatctcggctcactgctctgactacacccggataacagaagacagtttctcaaagccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctg

SEQ ID NO: 2669 - DNA, 1836 bp, Homo sapiens
agtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaagcttctgaaatcaagctgtg

SEQ ID NO: 2670 - DNA, 2227 bp, Homo sapiens
atgaggctgacacctttcagcttatcgactggcaactcctttaggtattctagacggctaaagaagaacatttttggcacagctccagccttgagagcgtctgaaatgagcctgcgaccttccagcaggatcttcccttgtttttcccgaaatggcctggactttactattgtcattacactgcttcagcctcctgtccccgggataagctttatcgtagcgaagcccagactcttcccaggtgctgggagcgcgggatgcggactcctcgagcggttgtttctctcgttgctcctgggcactggcctcagatggtgccggggctgcttcccaggagcgcgcttctgttccaccacctctccggaaggaaacaccactttcactgggctccgccgcagcgcccggacccagcgcctccaaggtcccaagcctggaccacctgcagcaacggtcgcacgacaaacctcgcgggtctcaccagcgccgccatgttccctgagacccgggctgcgtcacgaaagcgcgccgtcggcggctagtgacgtcacggcccgtggcgcccttcgtggactgggctgtacggtgcgcgtgacggctgcgtgcggcgggaatcatggctgctcgcagctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctg

SEQ ID NO: 2671 - DNA, 1314 bp, Homo sapiens
gcggcgggaatcatggctgctcgcagagctctgcacttcgtattcaaagtgggaaaccgcttccagacggcgcgtttctatcgggacgtcctggggatgaaggccctgcgcggtgttcagcttcaggagcgtggcgagttgccgttggggatcataggccttggagaagggcctaacacgattagtccccgcggtgtgcccacgcacgtcctttcatttaagccactcgtaaacgtttattgagccccgcccttgtggagcttaccgtctaccggaaaagacggttctgcggcatgaggaatttgaagaaggctgcaaagctgcctgtaatgggtatgataccttgtttcttaaaatctcctttaggctctgactacacccggataacagaagacagtttctcaaagccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaa

SEQ ID NO: 2672 - DNA, 3173 bp, Homo sapiens
aataagcatgaatacgacctggctacctgaaggaggtaggacggggaaccgagcagcagcaggtggtggaatgccagggaaatccaaccgtgcttcccacgctggcatcgctctgattatgaccaatcctctaatcttattctcacaattagggaggaagaaaaaaaaacaaacccaaaccaaaaaagaagttggtaggtgactctgtgagactactgttttataaagggagcgtttccttttataaaatttagctgagcagatgctaggcagcccacaggaggccactattcccctcagctgtacagtttgggaaaatacctacacacccggagaacagagagcttggtgtgtgttgagttcgctcctgttcatcagcagccctttccccgcctctggccaccagggggacctgcaaccaagtatgtgttctttcaggcgagcgggaacgcgtctgcataaatctagtccaatccagggccccgtagcaaggcgccaaagctgggggaagcgcatttctgttctctcgcgagcacgacgcggtgcctcccagtcctcctccggccctccctctccgccctcccggcccgcgagcgctcgggccccttccagtggctcgcggcaggtggcgctgtctgcggcgtcgcagcggcccgggctgcagcagagacgatctcccggcgggctgtgcggcccggctctccggcggcagcgagtgccacgtcccaagtgctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctccgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataag

SEQ ID NO: 2673 - DNA, 1976 bp, Homo sapiens
cacaccgatcgcccgccgccatgggctcctcgcaaagcgtcgagatcccgggcgggggcaccgagggctaccacgttctgcggcatcaatgagagaaggctcaagcacattgtcagaaataaggaagcttaagccgggcataatggtgtgcacctgtaatcccagctactccaatcaggagactgaggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctccgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaa

SEQ ID NO: 2674 - DNA, 883 bp, Homo sapiens
agtagaagcacctgcgtggtgtgcgggggtggagcgggggctggagggagagttaatgatttgccacaggctcatttcgcaacttaaccaagggtcagcttcccgtgaccatgtaccagctgcgtcctctgggccacgctccacttgcccgcttccacccggaaagccccccaggctgagtgcggcatgatctccatcaccgaatggcagaagattggtgtggggatcaccggtttcggcatcttcttcatcctctttggaacactcctgtactttgattccgtgctcctggcctttggaaacctgctgttcctgacgggcctgtccctcatcattggcctgaggaagaccttttggttcttcttccaacggcacaaactcaagggaaccagcttcctcctggggggtgtggttatcgtgctcctacgctggcccctcctcggcatgttcctggaaacctacggattcttcagcctctttaagggctttttccctgtcgccttcggcttcctgggcaatgtctgcaacatccccttcctgggtgcgctgttccggagacttcaaggcactagctcgatggtctgaaaaacagagatgagctccttgaacttggatcattggttgagggggctagagggagaatgggaaccaccccctcagtcccctgcactgactcactccccgacatatccggacctccccaagtccagaaggaaggaatggagctgagcaactgacgtcaaatccccaagtcgactcaagaggctgccaggaagcagagatgcagaccccaaggagactgggctggggctggtatcacaccctcactctatatttatgggaggaaaagtgaagattaaattcccaagttgtgcgtgtgtct

SEQ ID NO: 2675 - DNA, 2976 bp, Homo sapiens
agacgtggcggctctcgcctgggctgtttcccggcttcatttctcccgactcagcttcccaccctgggctttccgaggtgctgtcgccgctgtccccaccactgcagccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaaatgtccactgcaatggcaaaaatatttccagttgcactgtatctctggaagtgatgcatgaattcgattggattgtgtcattttaaagtattaaaaccaaggaaaccccaattttgatgtatggattacttttttttgtaaacatggttaaaataaaacttttgtggttcttctgaatcttaatatttcaaagccaggtgaaaatctgaactagatattctttgttggaatatgcaaaggtcattctttactaacttttagttactaaattatagctaagttttgtcagcagcatactccggaaagtctcatacttcttgggagtctgccctcctaagtatctgtctatatcattcattacgtgtaagtatttaacaaaaaagcattcttgaccatgaatgaagtagtttgtttcatagcttgtctcattgaatagtattattgaagatactaaatgatgcaaaccaaatggattttttccatgtcatgatgtaatttttctttcttctttcttttttttaaattttagcagtggcttattatttgtttttcataaattaaaataacttttgataatgtttactttaagacatgtaacatgttaaaaggttaaacttatggctatttttaaagggctattcatttaatctgagttttcccttattttcagctttttcctagcatataatagtcattaagcatgacatatccttcatatgatcactcatcttgagttaattagaaaatacctgagttcacgtgctaaagtcatttcactgtaataaactgactgtggtttcttaagaacatgacactaaaaaaaaagtgttttttttccaccgttgctgattattagacagtaggaaatagctgttttctttagttttacaagatgtgacagctttagtggtagatgtagggaaacatttcaacagccatagtactatttgttttaccactgattgcactgttttgtttttttaacagttgcaaagctttttaatgcataaaagtataattgaaatctgtggtatttatttacaaacatgtctacaaaaatagattacagcttattttatttttagttaaatctcttaatacacagagaactcccaatcttgctcatctaaataaggaaagacttggtgtatagtgtgatggtttagtcttaaggattaagacatttttggtacttgcatttgacttacgatgtatctgtgaaaatgggatgatattgacaaatggagactcctacctcaatagttaatggaataataagaggctactgttgtgtctaatgttcttcaaaaaagtaatatcctcacttggagagtgtcaaatacatactttgaggattgactttatataaggtgccctgtagaactctgttacacatatttttgacccatattatttacaatgtcttgataattctacctttttagagcaagaatagtatctgctaatgtaagggacatctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtacttttctatt

SEQ ID NO: 2676 - DNA, 5973 bp, Homo sapiens
gcagtcagcagaggagagcgccaggacgctacagcggctgaagaggcagtggcgcccgcggccgcagcgtcggggctggagcgatggcggcgaccgcggtggcggcggctgtggcgggaaccgagtcggcccagggtcccccgggcccggcagcgtcgctggagctgtggctcaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacggtgctggagatgtgcatgaaccactgtggggagaagttccacagcgaggtggccaaatttcgtttcctgaacgaactgatcaaagtgttgtccccaaagtacctggggtcctgggccacaggaaaagttaaaggaagagtcattgaaatactcttcagttggacagtctggtttccggaagacatcaagattcgagacgcttatcagatgctgaagaaacaaggaattataaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcagcacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactgtggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatctcagctcactgcaatctctgcctaccaggttcaagcgattctcgtgcctcagcctctcgagtagctgggactacaggcgtgagccagcacgcccagctaatttttgtatttttagtagagacaggatttcaccatgttggccaggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctataatcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccctgataatgccatgttttgtcctaaccttttgctgcagttaattactcttcctattatcttccatgaacttaagactgggcaaaaatgtttccttatctgtgagccactctgaacacaaacaggtcatgaagatagtgttgaaaacaataaatgacaaccaaaagaaaagtgaatattacctagtacaaatagtgtaaattgagacagaaaatgttaaagctagaaagcaagggcaatattctagaatacaaatagtgcttgcctactacaatattaatcccaaatcctttaaatatacccattatagaagatgcttacccagcgtcaagagtataaaagtgggtttgtttgttttcttgagacagggctttgctctgttgcccaggctggagtgcagtggcgtgattgtagctcaatgcagccttgaattcctgtgttcaggcgatcctccggcttcagcctctggagtagctgggactacaggtgcatgctgccacgcccagctaatgttgcagtttttcgtaaagactggatctctgtgttacccaggctggtctcctgggctcaagcagtcctcctgccttgacctcccaaagtgctgggattacaggcatgagccaccatgtcctgaccccagtttgttttaaagccaagcgatgcaccaagatgtttgtgtgcacatctgacagtggtaatctttgggtcagggaattatagataaattttctttaaattttttctgagctttctaaaatcagctgaaaataaaaccttattttttta

SEQ ID NO: 2677 - DNA, 1619 bp, Homo sapiens
ctggtcccctcaggaagcacatacctgctgctgaggcaatcagggtggttgtgagtaggagagtgagctggttcccttggggagcacatacctgctgccaagggaatcaggtgttctgggcagttcagagggtcccccttgcatattagtcacagattggccatggacgagtcacatgaccttcagtaagttgcttatttgtctagactttctggatgtcctagaaaggatgggtgtggcattactcttcatctggaagcaggtggagttactgttaggcatctcactctactcctttcttacaggaatcagtgatgctcctgttacaggcatggtaaggatgcccttcccagggcccggagagagaatgggagggtctcagacctgcccttgtgaggcagcactgcctggcgagcagagaggtgctcctgcactgtcccggtgggatcatggccttggaggtccaaagcctcttcctcacccatactgtctggctgatacctgggggagacaggttgcaccaggctcctgcttcctggaggtctgcccaggagctgcatgtgatcttgccctttctttcccctcttgccccaagagatgtcaccagtctgggccacagcagcttgggtgggctcaggagagctgtgccttggttttactgtggctgatggtcattcataccctggtcttattttagccattcctgatttgacaggtttctggtcagaattgctgtgaggaaaagaggaatccctcctccagcacgctgccaggcggtggtgttcagaacccttctgcagacaggaatttgctggacctcctctcagcacagccagctccgtgccctctgtgagtcttctgggcaaggggagtgggagagtgtggctcctgagtgcggttccttctcatgggacaagggccagagaatggtgctctaagacagcctctcgccctgtctcaaaaaaagtttaatgtgctgcttcccttttctcattttacttcttttcctaagtcgtaggaaaatacctgctttggccaagacatctgaaaagaggtttatttaaggactaggagtagtagaacatgaggtttttgccgtttgtttttgttttcccttctaataaccatataattgaagttaagcaaaatttgatccatggagaaacatacaacaaagtgcaaagtgccactccctaaaaacaaggttgaacgttccttttttgctttttttgtatacatgtagtggtacattcctgtgtcttgttacacaaacaggattttaatttataaaccgcactccagcatgaccttttcatattatatctgtgatgcatttcatatcagtttctataaatatgcctcagtcttaatagctacattacaatttattgcatggatgtatttgatcatttcccttttttggacatttacataatttctggtttggaggtgcttgggggagtgccttatagtatagatccctgaagggagaggttctctaaggtgtgaatgtaacaacattttcatagatcctgtccctttgcctctggaaaagtgcagcttaccttcacccaaacagcctgaaagtgcccatgttcctgatagaaaccaccaggctc

SEQ ID NO: 2678 - DNA, 2212 bp, Homo sapiens
gtcggaagaaacccgacagagcaaattggccgcagcgaagaaaaagttgagagaatatcagcagaggaatagccctggtgttcctacaggagcgaaaaagaagaagaaaataaaaaatggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagcc

SEQ ID NO: 2679 - DNA, 4260 bp, Homo sapiens
cgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatggctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 2680 - DNA, 1439 bp, Homo sapiens
ggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatattcaggacattctgaaggtgctggtgtccgaccttaaccgttccaatggggtagcgctccccccattggacaagtggaagacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatgg

SEQ ID NO: 2681 - DNA, 2027 bp, Homo sapiens
cgcggggcctgggccaggcggcagctaaggcccgcggtgacagcatgggtgaaggggagcggggcagaggaggccttgggctgttttcggcggcgggtgggggcgaggggctggcgggtcagagtcccgggtccaggccggggctctgactcgcggttggtgttcccccgaccccgcagcgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattatgcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagatatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaa

SEQ ID NO: 2682 - DNA, 1903 bp, Homo sapiens
aggacgtaagtgacggcgaaggcggtgcgacagcagctggagggcagaggaggcggcgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagtttttagattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattatgcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagatatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttctt

SEQ ID NO: 2683 - DNA, 808 bp, Homo sapiens
gcggaaggcggggtcggccctggccccgcccacatcatttcccttcctcggcccagccccacagcgcgcagcttcggcagggtggctttacggccggaggagagggtgggtcccagacctgaggtaggaggccgagctgaggggcggggaagaggctttttgcggcaggaccgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctc

SEQ ID NO: 2684 - DNA, 1984 bp, Homo sapiens
tttacggccggaggagagggtgggtcccagacctgaggtaggaggccgagctgaggggcggggaagaggctttttgcggcaggacgtaagtgacggcgaaggcggtgcgacagcagctggagggcagaggaggcggcgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattatgcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagatatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaa

SEQ ID NO: 2685 - DNA, 2114 bp, Homo sapiens
gtgacacgttctgggggaggggtagccgacagggggcaggttagagtcccgatcttggccagggtctcagaagtgtgtgtggcctgggcaagcagcccccggtctcgtctgggggtctgcggggctagctttggctgcggtgaccccactccctccccagagcatcccgagggccccgtcttcggacgaggagtgcttctttgacctgttgaccaagttccagagcagccgcatggacgaccagcgttgtcccctggacgatggccaggccggggctgccgaggccacggccgcccccaccctggaggacaggatcgcccagccctcgatgacggcctcgccccagaccgaggaattcttcgacctcatcgccagctcccagagccgccggctggacgaccagcgggccagcgtgggcagcctgccggggctgcgaatcacccacagcaatgcagggcacctccgaggccacggcgagccccaggagccgggggacgacttcttcaacatgctcatcaagtaccagtcctccaggatcgatgaccagcgctgcccgccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgccctgccaaatgtgaaaccctgctgtctcccccaccctccccaaaggtgtctctgagccgcctcttggggccaccaaggacagggccatgttctgtccccccagagctggtcttgggatggccgtgtgacaggcatgctccacccctccagcttcgtcctggggcagggctccctccaagcctgtctccccactccccggccagaggtcagcaaccacagaaggccccccagaccacgcatggcagaccaggctgcagtggcagccctgaggtgccccccgccgagtcccagggccctgcaggggcctcgacaggagccgggcctatctctaaagcagagggaatggctgggcatgaacttcgacattccaaaaccccaagccaggaaaaagggcagggcctggtcctagggatgcttactggcagcaagagcagtgcccagtcagggtgggaggtagcaccaggctctgtgaccctcacccaagtgggggggtggtcagtggaagctggggaggcttcactcagctcaaccctgcagaccccccatatgagaacccccctcctcccaccagctgggggagatgacatcactgctctctccatggggagggggctcacagggcaccaagttcgggatcctaggactggcaggacctgctggagcctgagatgggccccaggggcctgaggttgcctcctcctgtccagacccagccttggcacctcccaagactgccaagggccctaccatggccccacagcccccagggctggcagttccatctaggagggtgcctctaggccccactctcaggctaggatggagaggcagatctgggcctggtgaggtgacctgcttctggaggggcagggccgcacccgagagcagggacaggtgcccgaacacagggtctccaggacgtagcgcccccccgcatacttgaatgtatgtgcgtatttattgctcacgtctgtgccatgttgtcaatgggtcctttccaacccaagaggtacatttgtttttctgtttttcctgaaaaataaagtcggccaagtgag

SEQ ID NO: 2686 - DNA, 3344 bp, Homo sapiens
atggaggcgtcctgcctagagctggcgctggagggcgagcgtctgtgcaaggcgggcgacttcaagacaggcgtggccttctttgaggctgctgtgcaggtgggcaccgaggacctgaagacactgagtgccatctacagccagctgggcaacgcctacttctacctgaaggagcacggccgggcgctggaataccacaagcatgacctcctgctggcgcggaccatcggtgaccgcatgggggaggccaaggccagtggaaacctgggaaacacactcaaggtcctggggcgcttcgacgaggctgccgtctgctgccagcggcatctgagcatcgcccaagagcagggagacaaggttggggaggcgagggccctctacaacatcgggaacgtgtaccacgccaaaggcaagcaactgtcctggaacgccgcaaacgccacgcaggaccccgggcacctgccgcccgatgtccgagagaccctgtgcaaggcctccgagttctacgagaggaacctgtccctggtgaaggagctgggcgaccgtgcggcgcagggcagggcctacggcaacctgggcaacacccactatttgttggggaacttcacagaggccacgaccttccacaaggagcgcctggccattgctaaggagtttggagacaaggcagccgagaggagggcctacagcaacctggggaacgcccacgtcttcctggggcgctttgacgtggccgccgagtactacaagaagacgctgcaactgtctcggcagctcagggaccaggcagtggaggcgcaggcctgctacagtctgggcaacacctacacgctgctgcaggactacgagcgcgcggccgagtaccacctgcggcacctgctcattgcccaggagctggccgacagagtgggcgagggccgggcgtgctggagcctgggaaatgcctacgtgtccatggggcgcccagcgcaggccctgaccttcgccaagaagcacctgcagatctcccaggagatcggggaccgccatggggagctcacggcccgcatgaacgtggcgcagctgcagctggtgctcggccgcctgaccagcccggcagcctcagagaagcctgacctggccggctatgaggcccagggggccagacccaagaggacgcagaggctgagcgcggagacctgggacctgctgagactccccctggagcgggagcagaatggagacagccaccattcaggggactggcgggggcccagcagggactcgctacccctccccgtgaggagcaggaagtaccaggaaggcccggacgctgagaggaggccccgggagggcagccactccccgctggacagcgccgacgtccgggtgcacgtgccacgcacgagcatcccgagggccccgtcttcggacgaggagtgcttctttgacctgttgaccaagttccagagcagccgcatggacgaccagcgttgtcccctggacgatggccaggccggggctgccgaggccacggccgcccccaccctggaggacaggatcgcccagccctcgatgacggcctcgccccagaccgaggaattcttcgacctcatcgccagctcccagagccgccggctggacgaccagcgggccagcgtgggcagcctgccggggctgcgaatcacccacagcaatgcagggcacctccgaggccacggcgagccccaggagccgggggacgacttcttcaacatgctcatcaagtaccagtcctccaggatcgatgaccagcgctgcccgccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgccctgccaaatgtgaaaccctgctgtctcccccaccctccccaaaggtgtctctgagccgcctcttggggccaccaaggacagggccatgttctgtccccccagagctggtcttgggatggccgtgtgacaggcatgctccacccctccagcttcgtcctggggcagggctccctccaagcctgtctccccactccccggccagaggtcagcaaccacagaaggccccccagaccacgcatggcagaccaggctgcagtggcagccctgaggtgccccccgccgagtcccagggccctgcaggggcctcgacaggagccgggcctatctctaaagcagagggaatggctgggcatgaacttcgacattccaaaaccccaagccaggaaaaagggcagggcctggtcctagggatgcttactggcagcaagagcagtgcccagtcagggtgggaggtagcaccaggctctgtgaccctcacccaagtgggggggtggtcagtggaagctggggaggcttcactcagctcaaccctgcagaccccccatatgagaacccccctcctcccaccagctgggggagatgacatcactgctctctccatggggagggggctcacagggcaccaagttcgggatcctaggactggcaggacctgctggagcctgagatgggccccaggggcctgaggttgcctcctcctgtccagacccagccttggcacctcccaagactgccaagggccctaccatggccccacagcccccagggctggcagttccatctaggagggtgcctctaggccccactctcaggctaggatggagaggcagatctgggcctggtgaggtgacctgcttctggaggggcagggccgcacccgagagcagggacaggtgcccgaacacagggtctccaggacgtagcgcccccccgcatacttgaatgtatgtgcgtatttattgctcacgtctgtgccatgttgtcaatgggtcctttccaacccaagaggtacatttgtttttctgtttttcctgaaaaataaagtcggccaagtgagtgtg

SEQ ID NO: 2687 - DNA, 1111 bp, Homo sapiens
ctgtgtagggcatggacacagggagctcatggcagggctgacacagggtgtggtgggcacagggacaggaggcacgggaggcttcccgggatgtctgggaagtgttccaggccaaggctggggaggctggcccagggcaggtgacggacagaggcctggactggggtagcacccatgagaggggagaagtccggggcagtcggcgggtgccgaggagcatcccgagggccccgtcttcggacgaggagtgcttctttgacctgttgaccaagttccagagcagccgcatggacgaccagcgttgtcccctggacgatggccaggccggggctgccgaggccacggccgcccccaccctggaggacaggatcgcccagccctcgatgacggcctcgccccagaccgaggaattcttcgacctcatcgccagctcccagagccgccggctggacgaccagcgggccagcgtgggcagcctgccggggctgcgaatcacccacagcaatgcagggcacctccgaggccacggcgagccccaggagccgggggacgacttcttcaacatgctcatcaagtaccagtcctccaggatcgatgaccagcgctgcccgccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgc

SEQ ID NO: 2688 - DNA, 2265 bp, Homo sapiens
gcgcgggcggcggtgacatcacggccacggcggcgggaggggcggcggcgccccgcgcacatcacttcctcggcgcctccccgggggaggacgggcgaacgaggcgcggacggacaggcggacagcagggcggacagcagggaggacagcagggcgggcagggggcggacggccacggcgcggggggcgctcccggctcccgctcccgcgtccccgacccatggcgggcccggccccgcccgtggccgacgagctcccgggcccggccgccaggcgcctctactccaggatggaggcgtcctgcctagagctggcgctggagggcgagcgtctgtgcaaggcgggcgacttcaagacaggcgtggccttctttgaggctgctgtgcaggtgggcaccgaggacctgaagacactgagtgccatctacagccagctgggcaacgcctacttctacctgaaggagcacggccgggcgctggaataccacaagcatgacctcctgctggcgcggaccatcggtgaccgcatgggggaggccaaggccagtggaaacctgggaaacacactcaaggtcctggggcgcttcgacgaggctgccgtctgctgccagcggcatctgagcatcgcccaagagcagggagacaaggttggggaggcgagggccctctacaacatcgggaacgtgtaccacgccaaaggcaagcaactgtcctggaacgccgcaaacgccacgcaggaccccgggcacctgccgcccgatgtccgagagaccctgtgcaaggcctccgagttctacgagaggaacctgtccctggtgaaggagctgggcgaccgtgcggcgcagggcagggcctacggcaacctgggcaacacccactatttgttggggaacttcacagaggccacgaccttccacaaggagcgcctggccattgctaaggagtttggagacaaggcagccgagaggagggcctacagcaacctggggaacgcccacgtcttcctggggcgctttgacgtggccgccgagtactacaagaagacgctgcaactgtctcggcagctcagggaccaggcagtggaggcgcaggcctgctacagtctgggcaacacctacacgctgctgcaggactacgagcgcgcggccgagtaccacctgcggcacctgctcattgcccaggagctggccgacagagtgggcgagggccgggcgtgctggagcctgggaaatgcctacgtgtccatggggcgcccagcgcaggccctgaccttcgccaagaagcacctgcagatctcccaggagatcggggaccgccatggggagctcacggcccgcatgaacgtggcgcagctgcagctggtgctcggccgcctgaccagcccggcagcctcagagaagcctgacctggccggctatgaggcccagggtgagttccagggttgtgggggggtcttgctccccacaggcacggaccgcatcaggagctgcggaggggtgggatcgaggccaggccagcatggcggaggtggcagccgccagaaaatggcgcctacaagccagttcttcttggcctcagggacagcacaggcctgaggttcaccctgagcccttcccacccgcatcctgagtggcgctgcagggctgctggatgaaggacaggaggtggtcgcctgttgccccactggctgctccagggcctccacccccacctccccctggagccctcggtgcagggagggcttctgtcctcagacccaagtaggagagggctgctgggaggcgagagggcatcagccagagggctgggctgggctgggctgggctgtgggagccctatgtgcctggggcagtaatcaggcaaggcccaaggccatgcgaggccaccgtggtgacctcattcatggaccgctggtcgtcccatgccggtcagcagtgctgcagacacaggacagaacgtcccctgcaaagcgaaaagactaataggtgccaggggggtggtgccaggttgggccgacttcctgaggtggctggcaggtgggtgaggggcaggcttggggggagcagctgccccacccatgtgtcccccactcccaaaggtcttgagtttgccagcccccgagaagggatgcctgcctcccagaacgtacctggtgccccccaggcctgctaaggaccaggctgggaacaccaggcttggatgtggtgctgggctgccggagtttctttttcttatcttatttttaataattaaatgtttttataga

SEQ ID NO: 2689 - DNA, 2057 bp, Homo sapiens
ggcggtggtggccctgggcaccttgtgtcctgcctgcgctctgtgtggccaagcacccagcgtggctccctgctgctgtggagacagcctgtgatccgcagcatcccgagggccccgtcttcggacgaggagtgcttctttgacctgttgaccaagttccagagcagccgcatggacgaccagcgttgtcccctggacgatggccaggccggggctgccgaggccacggccgcccccaccctggaggacaggatcgcccagccctcgatgacggcctcgccccagaccgaggaattcttcgacctcatcgccagctcccagagccgccggctggacgaccagcgggccagcgtgggcagcctgccggggctgcgaatcacccacagcaatgcagggcacctccgaggccacggcgagccccaggagccgggggacgacttcttcaacatgctcatcaagtaccagtcctccaggatcgatgaccagcgctgcccgccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgccctgccaaatgtgaaaccctgctgtctcccccaccctccccaaaggtgtctctgagccgcctcttggggccaccaaggacagggccatgttctgtccccccagagctggtcttgggatggccgtgtgacaggcatgctccacccctccagcttcgtcctggggcagggctccctccaagcctgtctccccactccccggccagaggtcagcaaccacagaaggccccccagaccacgcatggcagaccaggctgcagtggcagccctgaggtgccccccgccgagtcccagggccctgcaggggcctcgacaggagccgggcctatctctaaagcagagggaatggctgggcatgaacttcgacattccaaaaccccaagccaggaaaaagggcagggcctggtcctagggatgcttactggcagcaagagcagtgcccagtcagggtgggaggtagcaccaggctctgtgaccctcacccaagtgggggggtggtcagtggaagctggggaggcttcactcagctcaaccctgcagaccccccatatgagaacccccctcctcccaccagctgggggagatgacatcactgctctctccatggggagggggctcacagggcaccaagttcgggatcctaggactggcaggacctgctggagcctgagatgggccccaggggcctgaggttgcctcctcctgtccagacccagccttggcacctcccaagactgccaagggccctaccatggccccacagcccccagggctggcagttccatctaggagggtgcctctaggccccactctcaggctaggatggagaggcagatctgggcctggtgaggtgacctgcttctggaggggcagggccgcacccgagagcagggacaggtgcccgaacacagggtctccaggacgtagcgcccccccgcatacttgaatgtatgtgcgtatttattgctcacgtctgtgccatgttgtcaatgggtcctttccaacccaagaggtacatttgtttttctgtttttcctgaaaaataaagtcggccaagtgagtgtg

SEQ ID NO: 2690 - DNA, 3633 bp, Homo sapiens
gcgcgggcggcggtgacatcacggccacggcggcgggaggggcggcggcgccccgcgcacatcacttcctcggcgcctccccgggggaggacgggcgaacgaggcgcggacggacaggcggacagcagggcggacagcagggaggacagcagggcgggcagggggcggacggccacggcgcggggggcgctcccggctcccgctcccgcgtccccgacccatggcgggcccggccccgcccgtggccgacgagctcccgggcccggccgccaggcgcctctactccaggatggaggcgtcctgcctagagctggcgctggagggcgagcgtctgtgcaaggcgggcgacttcaagacaggcgtggccttctttgaggctgctgtgcaggtgggcaccgaggacctgaagacactgagtgccatctacagccagctgggcaacgcctacttctacctgaaggagcacggccgggcgctggaataccacaagcatgacctcctgctggcgcggaccatcggtgaccgcatgggggaggccaaggccagtggaaacctgggaaacacactcaaggtcctggggcgcttcgacgaggctgccgtctgctgccagcggcatctgagcatcgcccaagagcagggagacaaggttggggaggcgagggccctctacaacatcgggaacgtgtaccacgccaaaggcaagcaactgtcctggaacgccgcaaacgccacgcaggaccccgggcacctgccgcccgatgtccgagagaccctgtgcaaggcctccgagttctacgagaggaacctgtccctggtgaaggagctgggcgaccgtgcggcgcagggcagggcctacggcaacctgggcaacacccactatttgttggggaacttcacagaggccacgaccttccacaaggagcgcctggccattgctaaggagtttggagacaaggcagccgagaggagggcctacagcaacctggggaacgcccacgtcttcctggggcgctttgacgtggccgccgagtactacaagaagacgctgcaactgtctcggcagctcagggaccaggcagtggaggcgcaggcctgctacagtctgggcaacacctacacgctgctgcaggactacgagcgcgcggccgagtaccacctgcggcacctgctcattgcccaggagctggccgacagagtgggcgagggccgggcgtgctggagcctgggaaatgcctacgtgtccatggggcgcccagcgcaggccctgaccttcgccaagaagcacctgcagatctcccaggagatcggggaccgccatggggagctcacggcccgcatgaacgtggcgcagctgcagctggtgctcggccgcctgaccagcccggcagcctcagagaagcctgacctggccggctatgaggcccagggggccagacccaagaggacgcagaggctgagcgcggagacctgggacctgctgagactccccctggagcgggagcagaatggagacagccaccattcaggggactggcgggggcccagcagggactcgctacccctccccgtgaggagcaggaagtaccaggaaggcccggacgctgagaggaggccccgggagggcagccactccccgctggacagcgccgacgtccgggtgcacgtgccacgcacgagcatcccgagggccccgtcttcggacgaggagtgcttctttgacctgttgaccaagttccagagcagccgcatggacgaccagcgttgtcccctggacgatggccaggccggggctgccgaggccacggccgcccccaccctggaggacaggatcgcccagccctcgatgacggcctcgccccagaccgaggaattcttcgacctcatcgccagctcccagagccgccggctggacgaccagcgggccagcgtgggcagcctgccggggctgcgaatcacccacagcaatgcagggcacctccgaggccacggcgagccccaggagccgggggacgacttcttcaacatgctcatcaagtaccagtcctccaggatcgatgaccagcgctgcccgccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgccctgccaaatgtgaaaccctgctgtctcccccaccctccccaaaggtgtctctgagccgcctcttggggccaccaaggacagggccatgttctgtccccccagagctggtcttgggatggccgtgtgacaggcatgctccacccctccagcttcgtcctggggcagggctccctccaagcctgtctccccactccccggccagaggtcagcaaccacagaaggccccccagaccacgcatggcagaccaggctgcagtggcagccctgaggtgccccccgccgagtcccagggccctgcaggggcctcgacaggagccgggcctatctctaaagcagagggaatggctgggcatgaacttcgacattccaaaaccccaagccaggaaaaagggcagggcctggtcctagggatgcttactggcagcaagagcagtgcccagtcagggtgggaggtagcaccaggctctgtgaccctcacccaagtgggggggtggtcagtggaagctggggaggcttcactcagctcaaccctgcagaccccccatatgagaacccccctcctcccaccagctgggggagatgacatcactgctctctccatggggagggggctcacagggcaccaagttcgggatcctaggactggcaggacctgctggagcctgagatgggccccaggggcctgaggttgcctcctcctgtccagacccagccttggcacctcccaagactgccaagggccctaccatggccccacagcccccagggctggcagttccatctaggagggtgcctctaggccccactctcaggctaggatggagaggcagatctgggcctggtgaggtgacctgcttctggaggggcagggccgcacccgagagcagggacaggtgcccgaacacagggtctccaggacgtagcgcccccccgcatacttgaatgtatgtgcgtatttattgctcacgtctgtgccatgttgtcaatgggtcctttccaacccaagaggtacatttgtttttctgtttttcctgaaaaataaagtcggccaagtgagtgtg

SEQ ID NO: 2691 - DNA, 2640 bp, Homo sapiens
gtcgggtgggggcggcggccgcggaaggccaggccggtgccctgcggggacgcccagcgcagcccagccccgcgcagcccagccctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcggacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgacgctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtgatctgtgtgagccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtg

SEQ ID NO: 2692 - DNA, 2607 bp, Homo sapiens
gtcgggtgggggcggcggccgcggaaggccaggccggtgccctgcggggacgcccagcgcagcccagccccgcgcagcccagccctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcggacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgacgctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtg

SEQ ID NO: 2693 - DNA, 2822 bp, Homo sapiens
aagtctgaatgctgtgtggacagaggaggaggacccaataagagaccacaccgctgttccagaccctctccatggatgatgtcctgcccctgatgccttgggagaccctgttggcacagggcagtccccagggctcgcctgacctcccagcagggcagcggaagcagcagccacagggtgacagggcccagggcctggcctctgagtcctggaagctcctggaggtgcccatcattcacataacgccatccagtgatggggagtcccccgcctgcaccccaaccccccgacgccggcagcagcagaggatgccagacccgcagagtctgtcccaggacagcaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgacgctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtggc

SEQ ID NO: 2694 - DNA, 2534 bp, Homo sapiens
cttttgtgcgggcggttgggtcgggtgggggcggcggccgcggaaggccaggccggtgccctgcggggacgcccagcgcagcccagccccgcgcagcccagccctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaaggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcggacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgacgctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtg

SEQ ID NO: 2695 - DNA, 2761 bp, Homo sapiens
cgcagccttgccagcattacccatcctcatcagaaactggcagcggcagccacagctcgggcaggcggctccagccccaggctggatttgcagaatctgtcctttgcctccaagcccagctttcagctgggagagggggaagaaggggcagtggcagcagttcttctggctctttctccctttctctctttctctttctgtgttcaagtcacattacatgggattctgttcttttgggacttcgtcatcttttccaatatgtcctgggacctccggagctgtaacggggatgctaaggacacggtcagtggattatcgtgactgtactaatgaaaggattcaagctctcctgcactgccagtaactccaaccgcagcacgccggcctgctcgcccatcctccggaagcggtctcgctcgccaaccccgcagaaccaggacggagacaccatggtggagaagggctcagatcactcctcggacaagtccccgtccacaccggagcagggcgtgcagcgcagctgctcctcccagtccggccggagcggcggcaagaattccaagaaaagccagagttggtataatgtgttaagccccacctacaagcagagaaatgaagacttcagaaagctctttaagcagcttccagacacggagcgcctcattgttgattactcatgtgcactccaaagagacattctccttcagggccgactctacctctctgaaaattggatctgcttctacagcaacatcttccgctgggaaactctgctgacagtccgtttgaaagacatctgttccatgactaaagaaaaaacagctcgcctcattcccaatgccatccaagtttgcactgattcagaaaagcacttcttcacttcgtttggggcccgggataggacatatatgatgatgttccggctctggcagaatgctctccttgaaaagcctctgtgtcccaaggagctctggcactttgttcaccagtgctatgggaacgaattgggcctgaccagtgatgacgaggactacgtgccccctgacgacgacttcaacacaatgggatactgtgaagagatccctgtggaagagaatgaagtgaatgacagctcatccaagagcagcatagagaccaagccagatgccagtccacagctgcccaagaaatccatcaccaacagcacactaacatccacagggagcagtgaggcccccgtctcgtttgatgggctgcccctggaggaagaggcgctggagggagacgggtccctggaaaaggagctcgccattgacaacatcatgggggagaagattgagatgatcgctcctgtgaactccccttcactggacttcaatgacaatgaggacatccccactgagctcagtgactcttccgacacacacgatgaaggagaggtccaggccttctatgaggacctgagtggccggcagtacgtgaatgaagtcttcaacttcagcgtggacaagctctatgacctcctcttcaccaactcgcccttccagcgggatttcatggagcagcggcgcttctctgatatcatcttccatccatggaaaaaggaggagaatggaaaccagagccgagtgattctttacaccatcacccttaccaaccctctggctcccaaaactgccactgtcagggagacacagaccatgtacaaggcgagccaggagagtgaatgttacgtgatagatgccgaagtcctcacccacgacgtgccctaccatgactacttctacacaatcaatcgctacacgctcacccgtgtggctcggaacaagagccgactcagggtctccacagagctgcgctatcgaaaacagccctgggggttagtgaaaacgttcatcgagaagaacttctggagtgggctggaggactacttccgccatttagagagcgagctggccaaaacggagagcacttatttggctgagatgcacagacaatctcccaaagagaaggccagcaagactacaacggtgcggaggaggaagcgtccccatgcccacctgcgagtccctcacctggaagaggtgatgagcccggtcaccacgcccacagatgaggatgtgggccacaggatcaaacatgtggcaggttccacacagacgcggcatatcccggaggacacccccaacggtttccacctgcagagcgtgtccaagctgctgctggttatcagctgtgtggtctccttcagtctggtgctgctggtcatccttaacatgatgctcttctacaaactctggatgttggaatacaccacgcagaccctcactgcctggcagggtctaaggctccaagaaaggttaccccagtctcagacagaatgggcccagctcttagagtcccaacaaaagtaccacgatactgagctccaaaaatggagggaaatcatcaaatcctcagtgatgctccttgaccagatgaaggactcgctcatcaaccttcagaacggcatcaggtcccgcgactacacgtcggaaagtgaagaaaagaggaatcgctatcattgacaaggcaggaacagggtggctgcaagaggcctgtgcaatacatgtacatagaccatataaatatatatatataaatatatatatatacagaatataaatatatatattatatacagattttaaaaaagagataatgcctatgtaccagggagaaggagcgggccctcccgcgccctgtgctggccggagcagcgttttcttatggtggagcagct

SEQ ID NO: 2696 - DNA, 7723 bp, Homo sapiens
cagccttgccagcattacccatcctcatcagaaactggcagcggcagccacagctcgggcaggcggctccagccccaggctggatttgcagaatctgtcctttgcctccaagcccagctttcagctgggagagggggaagaaggggcagtggcagcagttcttctggctctttctccctttctctctttctctttctgtgttcaagtcacattacatgggattctgttcttttgggacttcgtcatcttttccaatatgtcctgggacctccggagctgtaacggggatgctaaggacacggtcagtggattatcgtgactgtactaatgaaaggattcaagctctcctgcactgccagtaactccaaccgcagcacgccggcctgctcgcccatcctccggaagcggtctcgctcgccaaccccgcagaaccaggacggagacaccatggtggagaagggctcagatcactcctcggacaagtccccgtccacaccggagcagggcgtgcagcgcagctgctcctcccagtccggccggagcggcggcaagaattccaagaaaagccagagttggtataatgtgttaagccccacctacaagcagagaaatgaagacttcagaaagctctttaagcagcttccagacacggagcgcctcattgttgattactcatgtgcactccaaagagacattctccttcagggccgactctacctctctgaaaattggatctgcttctacagcaacatcttccgctgggaaactctgctgacagtccgtttgaaagacatctgttccatgactaaagaaaaaacagctcgcctcattcccaatgccatccaagtttgcactgattcagaaaagcacttcttcacttcgtttggggcccgggataggacatatatgatgatgttccggctctggcagaatgctctccttgaaaagcctctgtgtcccaaggagctctggcactttgttcaccagtgctatgggaacgaattgggcctgaccagtgatgacgaggactacgtgccccctgacgacgacttcaacacaatgggatactgtgaagagatccctgtggaagagaatgaagtgaatgacagctcatccaagagcagcatagagaccaagccagatgccagtccacagctgcccaagaaatccatcaccaacagcacactaacatccacagggagcagtgaggcccccgtctcgtttgatgggctgcccctggaggaagaggcgctggagggagacgggtccctggaaaaggagctcgccattgacaacatcatgggggagaagattgagatgatcgctcctgtgaactccccttcactggacttcaatgacaatgaggacatccccactgagctcagtgactcttccgacacacacgatgaaggagaggtccaggccttctatgaggacctgagtggccggcagtacgtgaatgaagtcttcaacttcagcgtggacaagctctatgacctcctcttcaccaactcgcccttccagcgggatttcatggagcagcggcgcttctctgatatcatcttccatccatggaaaaaggaggagaatggaaaccagagccgagtgattctttacaccatcacccttaccaaccctctggctcccaaaactgccactgtcagggagacacagaccatgtacaaggcgagccaggagagtgaatgttacgtgatagatgccgaagtcctcacccacgacgtgccctaccatgactacttctacacaatcaatcgctacacgctcacccgtgtggctcggaacaagagccgactcagggtctccacagagctgcgctatcgaaaacagccctgggggttagtgaaaacgttcatcgagaagaacttctggagtgggctggaggactacttccgccatttagagagcgagctggccaaaacggagagcacttatttggctgagatgcacagacaatctcccaaagagaaggccagcaagactacaacggtgcggaggaggaagcgtccccatgcccacctgcgagtccctcacctggaagaggtgatgagcccggtcaccacgcccacagatgaggatgtgggccacaggatcaaacatgtggcaggttccacacagacgcggcatatcccggaggacacccccaacggtttccacctgcagagcgtgtccaagctgctgctggttatcagctgtgtgatctgtttcagtctggtgctgctggtcatccttaacatgatgctcttctacaaactctggatgttggaatacaccacgcagaccctcactgcctggcagggtctaaggctccaagaaaggttaccccagtctcagacagaatgggcccagctcttagagtcccaacaaaagtaccacgatactgagctccaaaaatggagggaaatcatcaaatcctcagtgatgctccttgaccagatgaaggactcgctcatcaaccttcagaacggcatcaggtcccgcgactacacgtcggaaagtgaagaaaagaggaatcgctatcattgacaaggcaggaacagggtggctgcaagaggcctgtgcaatacatgtacatagaccatataaatatatatatataaatatatatatatacagaatataaatatatatattatatacagattttaaaaaagagataatgcctatgtaccagggagaaggagcgggccctcccgcgccctgtgctggccggagcagcgttttcttatggtggagcagctgaggagggcaggaaccgcctctcagcaccgacctcccctgatctccctcctcccaccctctgttccccaccccttcccttgctggccattcttggcttttagaagggaaatgttgagccaaagttatgcctgcgaagaccctaaggtctcaaaaagaagtcttaagacggcattgcttaaggtgcttcattccctaatccccttttgatttgtttccaaaataaaagagaatcttttcttccctaccccaggcttccccaggcattctcttgggaacacagaagcatcaagggagcccagtctaaactcctagggttggccgcccacttgatccagaccgtactgagtgtcagatggagaggatgcttggaaagctaggaaggctgcattgtgtggtggcaggctcccgagactcgtgttctgaaggatactctcctccatcacccctgcaccttcctccgacctgtgtagggtgtggacccagtaagggctgggaatttcttactttcccacccgctttctctctggtcttctcccaggctggatctgggcgaagtgtcactttttagtgcctaaagtcctattgtttctctgtgccctaagagcacattgtttattagccagggtggagcgttttcgaccttattaaacctcttttagtgcttctaagcaagtcaggtctgtggctctgaggccttcacttagagctgtcagtgtgatttccaggatgagtcagggtgtgctgggccctccaggatttgagagagggagagaaggcccttgccacgtccggggtgcagggtctacccacagaacactgtgagtggtgagcaccaagatgggttgccagcctcatttgctctttgaacgaaccaacattagccagtggagacgactgtctgagacagtttgcacatagaaaaagcatctgagccactggagggaaggatttggcaaaggtgcatgtgtttgggcaggaaaaggccaagtgaaatctatgccctacgggagccattcccaatcctgagtttctcagacttggcaatgggggttctggcgggggttggagtacaaatcctgctctggtctctggccccacagaggtgtaagatcattaagaagtagaaggcactagcttcaaagagtgagacattcagggccttttcagcattggcccactagcaccatgcatttatctgaattcacggggccctctgggcacattcatcatccctcatacactaactactgtttcttcatgtaatgaccaaaagagtcccaccagctccaggcagagcttgtggagattcatgaaagagtcatagccagtttggcatgcagaggtcttcagtcttgcttattcttctcctgggcttcttgacacaggggcagaagaaaccccagatgtcccagatgtcccagaacatcagcccaaaagacagaagattttatcactcatctaccccaaagataaagttgtatttttttcttagaatggcctttaattccctgtggcaattacagtttttgacttttccatgtgagaataaggccttggtatttccctaagggcaggatcagaaaacaggaaggtccatgcccaggtgatcctccaagggaggagggtgaggaggctccagggcatgagctagagtggatattcctcccctagaagaggagatgggaggaaatgcagtttcatgtaatccctgtgaagagtgcctatgcccacagcccagtgggtccttgttcagttcttgtccaggcctttgggtgagggacactggtagggatcaaggctcatgggctctgagccaaagaaggaggcatggtgcagactgctggaaatctcccccttggcacagccagaagccaaaactattcccagaaagttttgaatgcaaaacttgtagattcctgaatttattccatacataattatttccttaagttatttaattattaaaggtgccacggtgggacctttgggatgacttaaaaagggttctttgttgggagtcaagtgacagagcagacctggccgcagggagttgttctgcttctgctttacctctcaggaccattcccaggaggaaaaggtggcagagagggcagtactgagtatgtcagaagagccctcctggttttttagcgatttgaacccactagacaatgtgtgcacatagggaatgtcctttaagaatcatggatctcttgtaggctctctgtgttccaataattttttgactatcataccaggaaaaaaccaacaactctattcattcccaaacaaaatctcttcccccttagtcaatagcttgcgaaagacatcttaactcacccttgcagataagtcttggagtgaaacaaataaatagcattgtattcctggccatttgcctggctagttgctgtctacaagggagcatcaaaacatcactacttcttatgtaacttcttccagccagtgcttttattgttcgttttagtttactggggacacacaggagtctttctgtaatgacttatgtggtaaaatgtttgagagtttgcactcaattttaaagaatttgcagtttctaacaaggtgaagaacagctataggatctaaagttccattacagcttactgtgaaagaattgacaagactggcctcagacaagctaatcatggtgcgactctctcccttcctcatccacctctttggggacaagaggattacatctcaggccagcaagatcagctgcttgaagctctgtgtaagagcactgcactgacggtttggagacctgagcctgggtcctgacttttccattgactaagctctgtggccttgggcaagtcactccccctctctgagcttcagtatcctcctgtcacaggagggagttgggctagatcatctttaaggtaggttctagctttgacatcatcttgggggttaggccagaggctgggaagactgggtggactttctcaattgctctgccaggagggaacaagcccagaggctgaagcttcccagtatttagaggtgtggtagggcagtgtctgcattcccaggagacccagggtgattaaaatttattctttaggtggctaggagggctggggaggcccagtggaagagagagagagagagagagagagagagagagagagagagagagatcgagcttgatgtattgctcagtattcacttagaagggtttctttctctttggcctagtttgtgaagggatcttcctttggactttctctaagttgggagaagaacattcttttcaatggagctcatcttctatctctagggtctgttcagcctttcatctatccatccttcctctttattggtagaagaaacagtggagagtagccacttctggttctagcacttctcttttgttaagatagggtttggatttagtatgaagctttggctaaaacccttgggtttgccttagaacactgacactaagaacctggaatgacatggggaggacaaagagagctcaagaggaatgctttgtgagaagtggattctctccgtgtccctgccccccacccaaacttgaactatacctattacatttccaggcagtatccctaagatgagatcctggagaaaggactaggggaagtatctttctggatgcttgtggtcccagaagggtactttctgtgtcataccatgccacttctttaagctcttcagggcagccaaagccagcccttttctcctactgcccccaggagaaatagcactcttctcccttcccccagatggcagggctctggcctccctacacctcataccctgcctgcctcctccaggaggaatctccggggccccttcctgactctccccaccttcgccacttgtctctaggctatgggacaatcatcccattcaccacttgacatccttgacatccttgactttcattcccccaacctccagcaggttggccccaatcctcttcacctctgtgttttcttctagaagatgcattttgggtctgagaggagcattttcctggaaggccatcttttaaggcccctgcttgctgtcatagtgcagagcagaaacttgcacactatttagagagctcccttcccacctctctgcccagccttgttacctcacttctgctctggccatggctgtgaagggcccagccagctccctgttttgatgttctgtgcaacagctccggggtcttgtgactggagatcctcaacaggccctggagccaggactggagtcttggcagctgatgagcagcaccttgccggccaggaggagctgatgctgacgatctccccaacatctgaaggcttaaagaacattgtcgttcttcagccctccttgcttctctcaatacaataagacattgcagaagcaaaagggtggcctctgctccaggcaaggcagctggctctgtctggggcatcggcctggggcttgggtgccacgtgctgagattgcatagtcaaaacagccatttttgccaacaatagcttgtggctccccacattttcctaccctgcactcaagggccagaccactctctgcatggaccagaccatcttcccaaacccatggtgctttttccccaactcaacctagactccaaggtggggagggatgggtcagaggccatagtggcccctggataatcctgacgtggggtggagtggggtgaggcagagggagcagccccaacacctgcactgggccatctatgggaaagaacacgggtcgagtgcagtcgagttgtctggccatctgtatttggatctataactgtactttgcctggcgctgtgcgcaaggtcagaaaacttactgctagtacctagaaacacacaaggctgcccagccaaatcttaatgtaaagtagctagagccatggaagtacagtatgaattaaaaagaaaaaagtattgaactacaataataaa

SEQ ID NO: 2697 - DNA, 2805 bp, Homo sapiens
agattatatggagctgcgggagctgccgcctgggggaagagaggtgcagcttctgctaggtttgtgctctcctcccagggtctccttggcttccttccccaaagcagctcagagctggtatgaggtgagggtggggggcagccggccagcctggctgttgacggcaactccagggcttgtttcgcgcagccttgccagcattacccatcctcatcagaaactggcagcggcagccacagctcgggcaggcggctccagccccaggctggatttgcagaatctgtcctttgcctccaagcccagctttcagctgggagagggggaagaaggggcagtggcagcagttcttctggctctttctccctttctctctttctctttctgtgttcaagtcacattacatgggattctgttcttttgggacttcgtcatcttttccaatatgtcctgggacctccggagctgtaacggggatgctaaggacacggtcagtggattatcgtgactgtactaatgaaaggattcaagctctcctgcactgccagtaactccaaccgcagcacgccggcctgctcgcccatcctccggaagcggtctcgctcgccaaccccgcagaaccaggacggagacaccatggtggagaagggctcagatcactcctcggacaagtccccgtccacaccggagcagggcgtgcagcgcagctgctcctcccagtccggccggagcggcggcaagaattccaagtctcacaagcgcctctcaaaaaaaagccagagttggtataatgtgttaagccccacctacaagcagagaaatgaagacttcagaaagctctttaagcagcttccagacacggagcgcctcattgttgattactcatgtgcactccaaagagacattctccttcagggccgactctacctctctgaaaattggatctgcttctacagcaacatcttccgctgggaaactctgctgacagtccgtttgaaagacatctgttccatgactaaagaaaaaacagctcgcctcattcccaatgccatccaagtttgcactgattcagaaaagcacttcttcacttcgtttggggcccgggataggacatatatgatgatgttccggctctggcagaatgctctccttgaaaagcctctgtgtcccaaggagctctggcactttgttcaccagtgctatgggaacgaattgggcctgaccagtgatgacgaggactacgtgccccctgacgacgacttcaacacaatgggatactgtgaagagatccctgtggaagagaatgaagtgaatgacagctcatccaagagcagcatagagaccaagccagatgccagtccacagctgcccaagaaatccatcaccaacagcacactaacatccacagggagcagtgaggcccccgtctcgtttgatgggctgcccctggaggaagaggcgctggagggagacgggtccctggaaaaggagctcgccattgacaacatcatgggggagaagattgagatgatcgctcctgtgaactccccttcactggacttcaatgacaatgaggacatccccactgagctcagtgactcttccgacacacacgatgaaggagaggtccaggccttctatgaggacctgagtggccggcagtacgtgaatgaagtcttcaacttcagcgtggacaagctctatgacctcctcttcaccaactcgcccttccagcgggatttcatggagcagcggcgcttctctgatatcatcttccatccatggaaaaaggaggagaatggaaaccagagccgagtgattctttacaccatcacccttaccaaccctctggctcccaaaactgccactgtcagggagacacagaccatgtacaaggcgagccaggagagtgaatgttacgtgatagatgccgaagtcctcacccacgacgtgccctaccatgactacttctacacaatcaatcgctacacgctcacccgtgtggctcggaacaagagccgactcagggtctccacagagctgcgctatcgaaaacagccctgggggttagtgaaaacgttcatcgagaagaacttctggagtgggctggaggactacttccgccatttagagagcgagctggccaaaacggagagcacttatttggctgagatgcacagacaatctcccaaagagaaggccagcaagactacaacggtgcggaggaggaagcgtccccatgcccacctgcgagtccctcacctggaagaggtgatgagcccggtcaccacgcccacagatgaggatgtgggccacaggatcaaacatgtggcaggttccacacagacgcggcatatcccggaggacacccccaacggtttccacctgcagagcgtgtccaagctgctgctggttatcagctgtgtggtctccttcagtctggtgctgctggtcatccttaacatgatgctcttctacaaactctggatgttggaatacaccacgcagaccctcactgcctggcagggtctaaggctccaagaaaggttaccccagtctcagacagaatgggcccagctcttagagtcccaacaaaagtaccacgatactgagctccaaaaatggagggaaatcatcaaatcctcagtgatgctccttgaccagatgaaggactcgctcatcaaccttcagaacggcatcaggtcccgcgactacacgtcggaaagtgaagaaaagaggaatcgctatcattgacaaggcaggaacagggtggctgcaagaggcctgtgcaatacatgtacatagacc

SEQ ID NO: 2698 - DNA, 4177 bp, Homo sapiens
aaaaattatccgggcgtggtggcaggcgcctgtaaccacagctactcgggaggctgaggcaggagaatcgcttgaactgggaggcggaggttgcagttagccgagacggggccttggcactccatccagcctgaggaatgagagcgaaactccgtctcaaaaaaaaaaaaaaaaagtttccgagcaattcaccttttcgcacattggggcagggtatgccatttcctgggaggcacagtagtttgaggttgggaatagggaagtctcattgtgacccctagaaagacaagccttcaggctaacccggtaacacccatcgtcaggaatccttcacggccgccagagggcgcaaggagctgcggctggaagtactcggagggccggcggaggaggcgcgcggagcctgtaactcgcagcgcgcgctggaggtgggcgcggggcggtgcggtgcggtgcgcgcggggcggtgccgcggcggcggagggagccgcgatggagggcgctccgactgtccgtcaggtgatgaatgaaggggattcaagccttgccaccgacttacaggaagatgtagaggaaaatcctagtccaactgtggaagagaataatgtggtagttaaaaaacaggggccaaatttacataattggagtggtgactggagcttttggatttcaagttccacctataaagacaggaatgaggaatacagaagacagttcacacatctacctgatacagagaggctgatagcagattatgcttgtgctcttcagagggacattttgcttcagggacgactatacctttcagaaaactggctatgtttctatagcaacatcttcagatgggaaactacaatttctattgctttaaagaatataaccttcatgaccaaggaaaaaactgctcgactcatcccaaacgctatccagatagttacagaaagtgaaaagtttttcttcacatcttttggtgccagggatagaagttacctcagtatctttaggttgtggcagaatgtattattagataagagcctgactagacaggaattctggcaactgctccagcagaactatggcactgagctaggtttaaatgctgaggagatggaaaacttgtcactgtcgattgaggatgtgcagccaagaagtccaggaagaagcagcttggatgactctggggagagagatgaaaaattatccaagtcaatcagttttaccagtgaatcaattagtcgggtttcagaaacagagtcattcgatggaaattcatcaaaaggaggattaggcaaagaggagtcccaaaatgagaaacagaccaaaaagagtctcttaccaactttggaaaagaagttaactagagtgccatcaaagtcactggacttgaataaaaatgaatatctttctctggacaaaagcagcacttcagattctgttgatgaagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacagaaaacagccatggggccttgtcaaatctttaattgaaaagaattcctggagttctttggaggactatttcaaacagcttgaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggaaagaaaaaggaaatggaaaactataacgtcactcttattgtggtaatgagtatttttgtgttgttattagttttgttgaatgtgacactgtttctgaagctgtcaaagatagaacatgctgctcagtccttttaccgtctccgcctccaagaagagaaatctttaaatttagcctctgatatggtgtcaagagcagaaactattcagaagaataaagatcaggcccatcgtttaaagggagtgctccgagactccatagtgatgcttgaacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccctgaattgagtggtatggtctcatttctacagtgaagtctgatgctttgttagcacagaatccgtacatgtccaataggtcgcttttgtaactgagataagaccaagaggataaacaggacaatataagaagaaacctctatgtcattactgattttaaaggttctgttttcaggcatataacatttccaggtttgtgtactgtaaagattataatgtcttcatttatttagcatgcaaatttaatagtcaaactttttgaatctgcatgttgatgatgattatcagaaagggtcttctgccatgctgtatctttatgaaagaaatagttgttttttcttaaggtaactatcagaggtgggattatcttgcctcctcacttagaataccaacagtcaaaaggaagaaccatcctctgagttttaaaaaccagaaggttatgttaaaatctgggcatttagtgacagatcaaatgcatacttgaactaagattggcttcagcttagcagtctttcatggtggaagtgacacatctggttgaaaataatttgtgtattttcagtaaccatgtatggcttccttctttatgtatgtgtgtgacttgttttgattggtaagttataagccagacatagattttagctctttaataaaaacttcaggggcacgtatgtcccagtacaagtgtactgactatcaagttttaactcagatgcaagctttggctctttcataaaaagtttttatgcatatgtgtctccatacaagtggctcattaaaataagaactttgtaaactgacttaaaatcagatattttttcaagagttagggaaagttgaagtgttttactgttttgtctcttgagccctttctctggggaaaaaatacatatccatctatctatctatatataaactgtgtatacattcttactgtttgaacaactattgcctttaattaaatgtttcatttttctccagagtccccaaagccacatggcattattatagtcatttttgagatgcctgtagagaatgaaagtattgactccgttagagggaaaatgggtttctctgggtgaattccaacgaagcatacctaggggtaacagtgaacctacctgggtttgttttgttttggtaaggatttatgtagtgtctggctgtaagcaagaatgagtggattataaacttgaagatttctctgttaaagtcacaaaaatgatcgacaaacaatatttttgtgatgtttatttaaacgttgtattttataacatacttcaaggaagagtatcgaagtaagttgctttataaattaagactaaattcgtatggatgcagaattcaattaataaaatttgagcctgttacgtaaattgaatattaataaaattgaaaatttctga

SEQ ID NO: 2699 - DNA, 3475 bp, Homo sapiens
tgtagagtgaggtataacttccaattctgcattctgacctgcaaccttggaaagagtgctggtactacaaccaggaagtgacagataatgtgctttaaactacattagaaaagcttctcatagcaaaactgagagattgaagcagtgattatttttacatagttgtcattaaatatttggagctctgctgtgcatagagatggcaacatacttagaatacacagctttctgggccagaaattgatcttctgacttttgagccttatctgattactgcttggttcatctttattttgttaaactactctgtaggctgaaagggagagactctccttggtttgcagagcctgactagacaggaattctggcaactgctccagcagaactatggcactgagctaggtttaaatgctgaggagatggaaaacttgtcactgtcgattgaggatgtgcagccaagaagtccaggaagaagcagcttggatgactctggggagagagatgaaaaattatccaagtcaatcagttttaccagtgaatcaattagtcgggtttcagaaacagagtcattcgatggaaattcatcaaaaggaggattaggcaaagaggagtcccaaaatgagaaacagaccaaaaagagtctcttaccaactttggaaaagaagttaactagagtgccatcaaagtcactggacttgaataaaaatgaatatctttctctggacaaaagcagcacttcagattctgttgatgaagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacagaaaacagccatggggccttgtcaaatctttaattgaaaagaattcctggagttctttggaggactatttcaaacagcttgaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggaaagaaaaaggaaatggaaaactataacgtcactcttattgtggtaatgagtatttttgtgttgttattagttttgttgaatgtgacactgtttctgaagctgtcaaagatagaacatgctgctcagtccttttaccgtctccgcctccaagaagagaaatctttaaatttagcctctgatatggtgtcaagagcagaaactattcagaagaataaagatcaggcccatcgtttaaagggagtgctccgagactccatagtgatgcttgaacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccctgaattgagtggtatggtctcatttctacagtgaagtctgatgctttgttagcacagaatccgtacatgtccaataggtcgcttttgtaactgagataagaccaagaggataaacaggacaatataagaagaaacctctatgtcattactgattttaaaggttctgttttcaggcatataacatttccaggtttgtgtactgtaaagattataatgtcttcatttatttagcatgcaaatttaatagtcaaactttttgaatctgcatgttgatgatgattatcagaaagggtcttctgccatgctgtatctttatgaaagaaatagttgttttttcttaaggtaactatcagaggtgggattatcttgcctcctcacttagaataccaacagtcaaaaggaagaaccatcctctgagttttaaaaaccagaaggttatgttaaaatctgggcatttagtgacagatcaaatgcatacttgaactaagattggcttcagcttagcagtctttcatggtggaagtgacacatctggttgaaaataatttgtgtattttcagtaaccatgtatggcttccttctttatgtatgtgtgtgacttgttttgattggtaagttataagccagacatagattttagctctttaataaaaacttcaggggcacgtatgtcccagtacaagtgtactgactatcaagttttaactcagatgcaagctttggctctttcataaaaagtttttatgcatatgtgtctccatacaagtggctcattaaaataagaactttgtaaactgacttaaaatcagatattttttcaagagttagggaaagttgaagtgttttactgttttgtctcttgagccctttctctggggaaaaaatacatatccatctatctatctatatataaactgtgtatacattcttactgtttgaacaactattgcctttaattaaatgtttcatttttctccagagtccccaaagccacatggcattattatagtcatttttgagatgcctgtagagaatgaaagtattgactccgttagagggaaaatgggtttctctgggtgaattccaacgaagcatacctaggggtaacagtgaacctacctgggtttgttttgttttggtaaggatttatgtagtgtctggctgtaagcaagaatgagtggattataaacttgaagatttctctgttaaagtcacaaaaatgatcgacaaacaatatttttgtgatgtttatttaaacgttgtattttataacatacttcaaggaagagtatcgaagtaagttgctttataaattaagactaaattcgtatggatgcagaattcaattaataaaatttgagcctgttacgtaaattgaatattaataaaa

SEQ ID NO: 2700 - DNA, 2142 bp, Homo sapiens
ccaggtgatgaatgaaggggattcaagccttgccaccgacttacaggaagatgtagaggaaaatcctagtccaactgtggaagagaataatgtggtagttaaaaaacaggggccaaatttacataattggagtggtgactggagcttttggatttcaagttccacctataaagacaggaatgaggaatacagaagacagttcacacatctacctgatacagagaggctgatagcagattatgcttgtgctcttcagagggacattttgcttcagggacgactatacctttcagaaaactggctatgtttctatagcaacatcttcagatgggaaactacaatttctattgctttaaagaatataaccttcatgaccaaggaaaaaactgctcgactcatcccaaacgctatccagatagttacagaaagtgaaaagtttttcttcacatcttttggtgccagggatagaagttacctcagtatctttaggttgtggcagaatgtattattagataagagcctgactagacaggaattctggcaactgctccagcagaactatggcactgagctaggtttaaatgctgaggagatggaaaacttgtcactgtcgattgaggatgtgcagccaagaagtccaggaagaagcagcttggatgactctggggagagagatgaaaaattatccaagtcaatcagttttaccagtgaatcaattagtcgggtttcagaaacagagtcattcgatggaaattcatcaaaaggaggattaggcaaagaggagtcccaaaatgagaaacagaccaaaaagagtctcttaccaactttggaaaagaagttaactagagtgccatcaaagtcactggacttgaataaaaatgaatatctttctctggacaaaagcagcacttcagattctgttgatgaagtatgcagctgggcatggattagtcatacgctgtttacctgaatttaggactttaggaagatctactctggcccccagtggccaaatagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacagaaaacagccatggggccttgtcaaatctttaattgaaaagaattcctggagttctttggaggactatttcaaacagcttgaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggaaagaaaaaggaaatggaaaactataacgtcactcttattgtggtaatgagtatttttgtgttgttattagttttgttgaatgtgacactgtttctgaagctgtcaaagatagaacatgctgctcagtccttttaccgtctccgcctccaagaagagaaatctttaaatttagcctctgatatggtgtcaagagcagaaactattcagaagaataaagatcaggcccatcgtttaaagggagtgctccgagactccatagtgatgcttgaacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatag

SEQ ID NO: 2701 - DNA, 1576 bp, Homo sapiens
attctagcaaggcaccagcgacatcgcagactatgcttggttatatactgtattgaatgtccttccaatgtcacatttgtgcttatcacacacatgtgagttgggatatgtccttataaaaacaaatatctccagggaagtgataaagttcaggtttacagatgagccaagggagaaactaagttcttcactttaatgaagaagaaagctctctgaagtgagaagaagaaagggaattccagaatactggaggccacccaccatagccaagaaacactgcatttactggctggaagtaaaatttacccttctttgaaaagatcctgatattatctgtgtttctgatgtatacacacggagagcctgactagacaggaattctggcaactgctccagcagaactatggcactgagctaggtttaaatgctgaggagatggaaaacttgtcactgtcgattgaggatgtgcagccaagaagtccaggaagaagcagcttggatgactctggggagagagatgaaaaattatccaagtcaatcagttttaccagtgaatcaattagtcgggtttcagaaacagagtcattcgatggaaattcatcaaaaggaggattaggcaaagaggagtcccaaaatgagaaacagaccaaaaagagtctcttaccaactttggaaaagaagttaactagagtgccatcaaagtcactggacttgaataaaaatgaatatctttctctggacaaaagcagcacttcagattctgttgatgaagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacagaaaacagccatggggccttgtcaaatctttaattgaaaagaattcctggagttctttggaggactatttcaaacagcttgaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggaaagaaaaaggaaatggaaaactataacgtcactcttattgtggtaatgagtatttttgtgttgttattagttttgttgaatgtgacactgtttctgaagctgtcaaagatagaacatgctg

SEQ ID NO: 2702 - DNA, 3291 bp, Homo sapiens
ggggcgctgggtgcaggcgccgggatgaccgctttaagccggagcgaggccaccgaggagggcggcaaccaacaaatgcacagaaagacagcttctctgaacagtcctgtgtcctgcaaagagaaaccagacagagttgaggagcccccggactacagtctgcactggccagaaggcttgaagggtgaagagataaagaagtgtggccgagaagggataacactgaataaatacaaccagcaataccacaagctgtttaaggatgttcccttggaggaagtggttctcaaagtgtgttcctgtgccctccagagggacttcctcctccagggccggctctacatctcccccaactggctctgcttccatgccagcctctttggcaaggatatcaaggtggtcattcctgtggtgtctgtgcaaatgatcaaaaaacacaagatggcacggctccttcccaatggactggccatcaccaccaacaccagccagaagtatatctttgtgtcactgctctcccgggacagtgtatatgacctgctgaggagagtctgcacccacctacagccttccagcaagaagagtctgagtgtaagagaattttcaggggaacctgagtctctggaagtcctcatccctgagatgaagtggagaaaggtatgcccttcctccaggtccctgtctctcccagacaacatcccttgtatccctccatcatccgtggactccacagacagtttcttcccctccaggaagcctccaatgtctgaaaagtcaagagcccaagtagcttcagaaaatggtgggaggtgggcatggcccatgccaggctggggtcctgcctgccctaagaagatgccgaactgctctcccactgcaaagaatgctgtctatgaggaggatgagctggaggaggagcccaggagcactggggagctgaggctctgggattaccggctcctcaaggtcttctttgtgctgatctgcttcctggtcatgtcctcatcctacctggcgttccgtatttctcggctagagcagcagttatgctccttgagttgggatgacccagtccctgggcacaggtaacagccacttggcctttgtccccattccttctccaagaagaatgttctgggtgctaagtctccaccaatgatccctgtggtttatgctgctgctgtgctaagactgcctatgaaggaaaatattccagatccctcctcctccccgcagctcttctcttccctctatgagagatctgaagtacgtgtttacaaagtaactggcttctacaatttttggactcaagcaaaaagccagattttttggaaccaactgaggaattctgtacacaaagcttcagcaaacacttagagaaaacaaacaaacaaacaaactgggtccttggaaacagttctggcacacaggcagaacactggaggccacctcaaaggacagaggccatgctttcgcatttggaatgtggctctgccacacagctcactcctatggtggggtcagaggtcagaacacaaaccacccatgtgggctctgctccctcccaacactctgtgttcccacagggcttctctgcgggcagccaggcacctgtcaggcttgggcaggggcctgctgagaatctgtgaatgcagaggggagggctcatggccaggattccagccagagatgaatttccatgctctgggccagggctctgtgccggcccctcatgaggtggctggctgcattatggggagatgctgcccacggcggagatggtggcagtggctgtgaagaacagaggtacctgaattctgtgtcctcagctgtcactttccggtgagacaagtggagcagggcctttgatcactgtggtcacagacctggtactgggttttgcccttgtgtgctcaaacatttctaaggtgtcccaagccctggaaatagggaagggaagggtggaggcttggatctgaggtcttgctgtccactccctgcctgcctgcccgcatctcaggcatggccaacagcagcccgttgaggggggcttgtctggacagttgcgtgtgatggtgttgagccatcacagggcagaggtcacttgtgtcacccccatagtcattgggttgcaggccatggaggagggacctccactccatggggcctattctccattaaggtggaagtgtccactgtgggcctagcacagtgcaggaaccaggccagggggtctatctcatacctctggggacaggaaaggtagaggatgaggaggttggacgtggtggtggctttgccttggatattcctcttcctctatcaaggccttctcttcttctctgtgtcccacaactctggcctcatcgccctgggactcccatctgctaagatagtggctttggaggttctggaagggcttagtgaggaggccagaagtatcagggaaagttgctggtgatggggtgggcggtgtcagaagcagccactgttttcccctcttcagacactgagagattaatcagggaatgaaatccaggtggaaattatttattgtgaagcagacgactgtctgtcctgtttatgacaaacccaaatgagaattggagggactaccagtaagtggtctcttcatgctctccccatcccagtttttaggatgaaatttagagcctggccttttgtgttgcttgcaccaaatctgtatgtctcaggtgaaactcactgttccatgaatggtcatcctttttttttttttttttttggaaccagcccctttcaccctttcatccgtcttttttttttaggaaaataacccttcttgcttcagcacttctccctggtccttgctgaaagacagagataaaaatccattctctgagccttgcttggttgtcagaggccatgagaggtgccagttataggtggatgtgccaagatgctggtgaacttggtcttcagctatacccaggctcagaaagggcaagagccatgctgcagcgtaggtgactttggaggtgcacttggggcccagggctttgagtgttgcgggtgtgcctgtccctccagatagtgctctgtttctctctgttgtccccctgcctggtcctctggggccactgtgctttctgctgtgtgcatttataaatgatgtgtattttatatagacctgcttgcattggctgatgctcctctaattccctgagtttgattcaaccacccttgggttgttttgctatggccttagcctttgaaaatattttaaaataaaaaacttgatttttctagtgt

SEQ ID NO: 2703 - DNA, 2119 bp, Homo sapiens
ttaacagaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcctaaaagagcttccaaactcatttttgaataatactaggctacaaagaattacactgtgaattcattaagggtaacaccaaatcactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaaacattcttgggcccccgcatcattggcttaaggcatgaaatctcagttgaaacccaagaccacaaatctgctgtcaggggaaataacacacacgacaactatgaaaatgtggaagcaggtcctcccaaagctaaaggaaaaaccgataaggaactatatgaaaacacagggcagtctaatttcgaggagcatatctatggaaatgagacatcttctgactattataacttccagaagcctcgtccttctgaagttcctcaagatgaagatatatacattcttccagattcatattagcttttcaaaatattgacttttgttattggatgataaatattcactgtaatttttcaacagcaaagacaaggaatcaaactaaatgttgatcaactgtagactggataaagaaaatgtggtacacatacaccatagaatattatgcagccgtaaaaaaagaacaaaactaacatgggaacagaaaatcaaataccacatattctcacttaaaagtgggagctaaataataagaacacatggagagaaggagaggaacaacagacactggggcctacttgagggaggacagtggaaggagggagaggttcagggaaaaaaaaaatatcaggtactatgcttagtacacacatgatgaaataatctgtacaccaaacccccaagtcacaagtgttcctacataacaaacctgaacatgtacccctgaacataaaattataattaaaatattaaaaataattcactgtgatttttattgtactgatgccattcttaatcaagttctgataagtggatggtctctgcctatctccacctttctgaatcctatgtgtatcgctgtggattaattctagatatcttctccaccctccttgcaccagactaaatctgtattatgtgatattgattcttccttctaaatattacccgttatctctttcctttatttctaccattatctttatctggctcagaattattgtcataggctcctaactgttcctcctgcttctagtttctacccactcaatcaattaccgatggtgttgccagatttatcttcagaaaatattcctaacagccacattatttctttcacttaaaatgttttaatgccccctctttgcaaaagacataatacccataatttgaactccaaaatttatggttttccacaattggttccaattcacttttccagtgacttctcttactatctctcatttctttgccttcagcagaatcatcttaaaacctgccaaacttatccttccttcacagctttgcttttctgcctcttctctcaagcctgcttcagatcataagttcttccacacatctcctgaatcactccaaacccgcatttacctttttattttctgatataagctttgatgcctcttcaattcttaggacatttaaacatatgaatgttgccacagcattttattacctagcttcatatgaaaatgtcttaaattcccacctaaatgaaaagaaactgcccaaatgcctagaacatcacataaggcactaaatgcctcatgttttactgacgggaattgaattgtacattttgctgagtagttttgagaaaaaaatctaataaattcatctgttattcatccat

SEQ ID NO: 2704 - DNA, 3016 bp, Homo sapiens
aaggaagtaacccaccaaagtgaaaaagaggaacaagttctaacccaatgcaggtttaaaacataaccaaaagaacaaaagagagagcttgacacaccaatcttgaggtgttgtgccattctctgggaacatacagatgaaatgacctgaaccctgcccaccatttaaccaaaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcctaaaagagcttccaaactcatttttgaataatactaggctacaaagaattacactgtgaattcattaagggtaacaccaaatcactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaaacattcttgggcccccgcatcattggcttaaggcatgaaatctcagttgaaacccaagaccacaaatctgctgtcaggggaaataacacacacgacaactatgaaaatgtggaagcaggtcctcccaaagctaaaggaaaaaccgataaggaactatatgaaaacacagggcagtctaatttcgaggagcatatctatggaaatgagacatcttctgactattataacttccagaagcctcgtccttctgaagttcctcaagatgaagatatatacattcttccagattcatattagcttttcaaaatattgacttttgttattggatgataaatattcactgtaatttttcaacagcaaagacaaggaatcaaactaaatgttgatcaactgtagactggataaagaaaatgtggtacacatacaccatagaatattatgcagccgtaaaaaaagaacaaaactaacatgggaacagaaaatcaaataccacatattctcacttaaaagtgggagctaaataataagaacacatggagagaaggagaggaacaacagacactggggcctacttgagggaggacagtggaaggagggagaggttcagggaaaaaaaaaatatcaggtactatgcttagtacacacatgatgaaataatctgtacaccaaacccccaagtcacaagtgttcctacataacaaacctgaacatgtacccctgaacataaaattataattaaaatattaaaaataattcactgtgatttttattgtactgatgccattcttaatcaagttctgataagtggatggtctctgcctatctccacctttctgaatcctatgtgtatcgctgtggattaattctagatatcttctccaccctccttgcaccagactaaatctgtattatgtgatattgattcttccttctaaatattacccgttatctctttcctttatttctaccattatctttatctggctcagaattattgtcataggctcctaactgttcctcctgcttctagtttctacccactcaatcaattaccgatggtgttgccagatttatcttcagaaaatattcctaacagccacattatttctttcacttaaaatgttttaatgccccctctttgcaaaagacataatacccataatttgaactccaaaatttatggttttccacaattggttccaattcacttttccagtgacttctcttactatctctcatttctttgccttcagcagaatcatcttaaaacctgccaaacttatccttccttcacagctttgcttttctgcctcttctctcaagcctgcttcagatcataagttcttccacacatctcctgaatcactccaaacccgcatttacctttttattttctgatataagctttgatgcctcttcaattcttaggacatttaaacatatgaatgttgccacagcattttattacctagcttcatatgaaaatgtcttaaattcccacctaaatgaaaagaaactgcccaaatgcctagaacatcacataaggcactaaatgcctcatgttttactgacgggaattgaattgtacattttgctgagtagttttgagaaaaaaatctaataaattcatctgttattcatccatacaaggaatatttgttgtgtcttctatctacttgctattgtgctgtgcacctgagggacatgggttggtggaggggttacaaaattaaaaagagagacatggatcctgaacacatacagtctagtaggaaagaaaacatagtaaacaaatgaatacgatgctgctcatgaagctatgatagctcatctctaaatccactcttttatttgctcctctgaattgcttgacctgggcctctgcaaacatttcttttgccaggtggatccattctattctctaccaatagggggcactaaggaagaccgaaaggcagtaggaggcaacagggaattgctcctgcctattctttctgttgcccccgcaggaatttattgccatgtggtttactccagcatcactggttgtttgcagctttctagtttcttccatcattcccaggaccagcttctctgcaacctgtcagaagcaccagcaccagccaggtggcaccctcccttagactctgacagccagactctccttcaacctcctgaagtggtgcaggagacaagtggtaccctcagagttctgcgtcccagcctggcagggctcctcctctgaggtctggtaactctcagccaagattgttacagttactatctctgtggtacctgtgtccccttttttgtttttccatcctgccaatgcctgtttagccaattatctatattaaattctctctgttaaaacaaa

SEQ ID NO: 2705 - DNA, 731 bp, Homo sapiens
aaggaagtaacccaccaaagtgaaaaagaggaacaagttctaacccaatgcaggtttaaaacataaccaaaagaacaaaagagagagcttgacacaccaatcttgaggttatcacgctataatagagaatggactcattaatatgggattacagaggaaggaatggttaagaaaaagacatggcctctgactgctccaaaaaaggataagcagggcttcacagaagaggtgacagaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcctaaaagagcttccaaactcatttttgaataatactaggctacaaagaattacactgtgaattcattaagggtaacaccaaatcactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaaacattcttgggcccccgcatcattggctt

SEQ ID NO: 2706 - DNA, 769 bp, Homo sapiens
ggaagtaacccaccaaagtgaaaaagaggaacaagttctaacccaatgcaggtttaaaacataaccaaaagaacaaaagagagagcttgacacaccaatcttgaggtgttgtgccattctctgggaacatacagatgaaatgacctgaaccctgcccaccatttaaccaacaggtttctggatggcagatcattcaaccttctttttcttgagttttctactctgctgtcatcttccactcatttctgcttcattttgtgattcgttaacagaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcctaaaagagcttccaaactcatttttgaataatactaggctacaaagaattacactgtgaattcattaagggtaacaccaaatcactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaaacattcttgggcccccgcatcattggctta

SEQ ID NO: 2707 - DNA, 1734 bp, Homo sapiens
agggatctattttggagacaacaaacttgactaaggaatctcaagaagaaaatataattctgctgccaggccccaatggagcaaatagagctcgggacccaggggcctttggaaggaacaggaatgcggttagaggagtgcaggaaggggctcttgggatgtgccacccaggaagacagagggccagtgctgctacctgcagccacacgactccacgaccatgtcctcatactgcttatacaccacgttgttggcagagtcaatgaagaggatgctgatgggactcagccgcgtgggcacacagcaggtgggtggtgtggactcggggtccatggagttcatcagggtctggatgactgcatgattcgtgggctccaggtgggagcgcaatgggaactcgcacagcccctcgcagtggaaagcctcgtactcaaggggtgcgatgatccagtcgtcccagcccatgtccttgaagttgacatgcagtgccttccgactgcagcgagccttaaggttcttgctgggtcgcttgccctggcgagtggccagtggggcccgccgttttcgccgctggctgaacaggtactcatacacggtcttatcgtcctggccagagcgggccttaatctcattaaagaacaggtcccgtttcttggtgcggccaaacaccaggaacagggccttctcgtggacctgccgggcggcgcggtcgaagcccaggccacggaggtccacggccctgccccgttcccaggcctccagctccaggcacagctgggccgagttcttaaagtttcggaagagcttccagatgtcgaacacctcccagccagatccgtccaggcctggcacggagcgcacatccagcaaggaggccggctgccggccgctggggcagctggacagcttcagctgggcagcccgcccgcctccgggggccgctggcttggccgtgtccgagggcttcttccgcaagatccgcagctcggcccccagcagcccatccttctccagggcactaatgtcaaacacgtacctctgcttcctgaccacgggacctcggtcatctagagagaacacccagaagtcattccctgcaacctcaccaagggagccagtcacttcgaggctgcgggggaaggccccagctctctccccgtccagagagctttctttcacctctgccccattctgacagaagccaagagccaaaccactgagagcctttttgaaaatgagagcatttcctacatagccgaccaagtaggggtgttcacctgaagatgtggctggggatgatttgcgtgattctggtgtttgtgtcatgatatacgtgttatcagagatttatcagctttgtaactgccttctacctatctctctcccagccatgagctaacgtgatgtctcatttgtgagataggtggagtgagcattaaaattactcctgttgactgggcacagtggctcacacctgcaatcccagcactttgggaggctgaggtgggtggattgcttgagctccggagttcgaaaccagcctgcacaacatggtgacactctgtctctacaaaaaatacaaaaattaaccaggcatggtggcgtgcacatgtagtcccagctactcaggaggctgaggtgggaggattgattgaccccagggaggtcaaggcttcagtgagccgtgaattcgctattgcactccggcctgggcaacagagaaagaccctggct

SEQ ID NO: 2708 - DNA, 1878 bp, Homo sapiens
gaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactc

SEQ ID NO: 2709 - DNA, 2128 bp, Homo sapiens
ttttccgacagaggcctgcccgtgattggctgctcgtactatttacgtcctttcgatgttgcgtcatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatgattgctaagtgtttttttatttttgcatatttattgaactgtctaattgaatacagcttgctcttgtcacc

SEQ ID NO: 2710 - DNA, 2375 bp, Homo sapiens
gtcatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatgattgctaagtgtttttttatttttgcatatttattgaactgtctaattgaatacagcttgctcttgtcacctcttcaagctttcaagcctttatagaaaagcttctttgtggcttacactggaaattatgaaagcagtttttctcctaagacttttggtttctcgcattgcctctcagactaagcactaaaaagcaaagcaaaacagaactagttctgtcttaatgaaatatatcaacccaaaagtgtaatgaggaaaatgcttcattagtttcccctagcagacttttacttctcttacactgctacaccattactttcttgagacatttgtaagttctttgatacagaagagttatatttagaagtctttaatgaaggg

SEQ ID NO: 2711 - DNA, 1301 bp, Homo sapiens
acgtcctttcgatgttgcgtcatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcag

SEQ ID NO: 2712 - DNA, 5725 bp, Homo sapiens
cagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgcacaaaaagctttaaacaagttaaaatctaggcaacagactccctgaagtgttgactgcccaacttaatcatgactgtgattcaaaaatgttaataaataaaccaaggtgtagatcatggggaattcatatgctgggcaactgaaatctgctcgatttgaggaagctctccacaactccatagaagcctccctcagatgtagtagtgtggtaccacggccaattttttcccagctatacctggaccctgaccagcatcctttctcatctgcagatgtcaaacccaaggtggaggatctggacaaagatttggtaaaccgctacactcaaaatggaagtctggatttttctaacaatctaacagttaatgaaatggaagatgatgaagacgatgaagaaatgtctgattcaaacagcccaccaattccctattcacaaaaacctgccccagaaggatcttgcactacagatggtttttgtcaagcaggaaaggatttgcgtttggtatcactgtgtatggaacaaattgacatcccagcaggattcctcctggtgggggccaagtctcccaatctgcctgaacacatcctagtttgtgctgtggacaagcgatttctaccagatgatcatggaaaaaatgcacttttagggttttctggaaattgtatcggctgtggagaaagaggatttcgatatttcacggaattttccaaccacattaacttgaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagccccttttatctgccccagttccacagaccccactaactggaattttacaacccaggcccattcctgcaggggaaactgtaattgttcctgaaaacctgctgagtaactcaggagttagaccagtaattctgataggctatggcactttaccctatttctatggaaatgttggtgacattgttgtgagtcctctgctggtgaattgctacaagattccacagttggaaaacaaagatttggaaaaattagggttgaccggcagccaatttctgagcgtggaaaacatgattcttctgacgatacagtatcttgtgcggctgggtcagcaccagtcccgagctctggcagagagcatgctcaccacaagtgagtttttgaaagaaattagttatgagcttatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctggatttagataatgaaaccttccacatttatcaaccgcagctaacagttgccagaaaactcttatcccaggtgtgtgctatagcggacagtggcagccagagcctggacctcggtcacttcagcaaagtagacttcatcatcattgttcccagatcggaggtgttggttcagcaaactcttcagcggattcgacaatcaggtgtccttgtagacttgggtctggaggaaaatgggacagcccatcagagagcagaaaaatatgttgttcgtctagacaatgagattcaaaccaagtttgaagtttttatgaggagagtgaaacagaacccgtacacactgtttgtgctagttcatgacaactcccatgtggaactaacgagtgtcatttcaggctctttgtcacatagcgaacccagtcatgggctagctgatagagtcattaattgcagagaagttctggaagctttcaacctcctggtgctccaggtcagctccttcccatacactctgcagacccaacagtcccgcattagctctagcaatgaggttcactggatacagctggatactggggaggacgtgggctgcgaggagaagctgtactttggcttgagtgagtacagcaagtctctgcagtgggggatcacgagcccacttctgagatgtgacgagacttttgaaaaaatggtgaacacactcttggagaggtaccccaggctgcacagcatggtcgtccgctgctatcttctcatccagcagtactctgaggccctgatggctctcaccaccatggcgtcactccgcgaccacagcacaccagaaacactcagcattatggatgacctcatcagctccccaggcaaaaacaaaagtgggaggggacacatgctcattatcagggtgccctcggtgcagctggcgatgttagccaaggagcggctacaggaggtgcgcgacaaactgggtctgcagtatcggtttgagatcatccttgggaacccggccaccgaactcagtgttgcaactcactttgtggcgcgattaaagagttggagaggaaatgaaccagaagagtggatccctcggacataccaagatttagacggtctaccttgtattgtgatattaactggcaaagatcctcttggagaaacctttcccaggtctttgaagtactgtgacctccggttaattgactcaagctatttaactcgcacggccttggagcaggaggtgggtctggcatgctgctatgtctcaaaagaggtcatccggggacccactgttgccctggacctcagcgggaaggagcaggagagagctgctgtcagtgagaatgactccgatgagctgctcatcgacctggagcggccccagagcaacagcagcgctgtcacagggacctcgggttccatcatggagaatggagtgagctcttccagcacagctgacaagtcccagaagcagtccctgacccccagctttcagagcccagccaccagcttggggctggatgaaggggtctccgccagctcagctggagccggagccggggagactctgaagcaggaatgtgactccctgggcccccagatggcgagcagcaccacctccaagccgtcatcatcatcctcaggacccaggaccctcccatggccgggacagcccatcagaggctgccggggcccacaggcagccctgccaccagtggtgatcctatccaaagcggcctacagtctcctgggctcccagaagagtggcaagctgccatcctcctcctccctgctgccccacgccgacgtggcctgggtgagctccctgcggccactcctgaacaaggacatgagcagtgaggagcagtccctctactacaggcagtggaccttggcccggcagcaccacgctgactatagcaaccagctggacccggcctctggcacccgaaacttccacccccgacggctcctgctgacagggcccccacaggtgggaaagacgggctcctatttacagttcctcaggatcctcttccgcatgctcatcaggctcctggaggtggacgtgtatgatgaggaggagatcaacaccgatcacaatgaaagcagtgaagtgagccagtcagagggagagccctggcctgacatcgagagcttcagtaaaatgccttttgatgtcagtgtgcatgaccccaagtacagtttgatgagcctggtgtatactgagaagctggcaggggtcaaacaagaagtgataaaggaatccaaagttgaagagcccaggaaacgggaaactgtatccataatgctgaccaaatatgcagcctataacacctttcaccactgtgaacagtgccgccagtacatggacttcacctctgcctcccagatgtctgactccacccttcatgccttcacattctcttcttctatgctgggagaagaggttcagctctatttcatcattcccaaatccaaagagagtcattttgtcttcagcaagcagggcaagcacctggagagcatgcggctgcccctggtttcagacaagaatttgaatgcagtcaagagccctattttcactccttccagtggtcgacatgagcacggactcctaaaccttttccacgccatggagggcatcagccaccttcacctcctggtggtcaaagagtatgagatgcctctgtaccgcaagtactggcccaaccacatcatgctggtgcttcccggcatgttcaataatgcaggcgtgggtgctgccaggttcctcatcaaggagctatcatatcacaacctagaattggagagaaaccgcctggaggagctaggcattaaacgccagtgtgtctggcctttcatcgtcatgatggatgactcatgtgtcctatggaacattcacagtgttcaggagccatccagccagcccatggaagtaggagtttccagtaagaatgtgtccttgaagactgtcttgcagcacattgaagccacaccaaaaattgtccactatgcaatcttgggcatacagaaatggagcagcaagctgacttctcagagcctaaaggccccattctctaggtgtcacgtgcatgatttcattctcctcaacacagacttgactcagaatgtgcagtatgacttcaacaggtatttctgtgaagatgctgactttaatctgagaacaaacagtagtggcctgctcatctgccgctttaataacttcagtctcatgaagaaacatgttcaggttggagggcaaagggactttatcattaaaccaaagatcatggtgtcagagagcttagcacccatcttgccccttcaatacatctgtgctcccgacagtgaacacacactactggcagcccctgcacagtttctcctggagaaattccttcagcacgcctcatataaactcttccccaaagccatccataacttcaggagtcctgtgctggccattgactgctaccttaacattggaccagaggtggccatatgctatatcagctccagaccccactccagcaatgtcaactgtgaaggggtgtttttcagtggactccttttgtacctctgtgactcttttgtaggtgctgatcttaagaaatttaaatttctaaaaggtgctacactgtgtgtcatctgccaagacagaagttccttgcgccaaacaattgtccgcttagagctagaagatgagtggcagttccgcctccgggacgagtttcaaactgctaacagcagtgatgacaagcctctctactttcttactggacgtcatgtatgagcttttgaa

SEQ ID NO: 2713 - DNA, 5871 bp, Homo sapiens
cagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgcacaaaaagctttaaacaagttaaaatctaggcaacagactccctgaagtgttgactgcccaacttaatcatgactgtgattcaaaaatgttaataaataaaccaaggtgtagatcatggggaattcatatgctgggcaactgaaatctgctcgatttgaggaagctctccacaactccatagaagcctccctcagatgtagtagtgtggtaccacggccaattttttcccagctatacctggaccctgaccagcatcctttctcatctgcagatgtcaaacccaaggtggaggatctggacaaagatttggtaaaccgctacactcaaaatggaagtctggatttttctaacaatctaacagttaatgaaatggaagatgatgaagacgatgaagaaatgtctgattcaaacagcccaccaattccctattcacaaaaacctgccccagaaggatcttgcactacagatggtttttgtcaagcaggaaaggatttgcgtttggtatcactgtgtatggaacaaattgacatcccagcaggattcctcctggtgggggccaagtctcccaatctgcctgaacacatcctagtttgtgctgtggacaagcgatttctaccagatgatcatggaaaaaatgcacttttagggttttctggaaattgtatcggctgtggagaaagaggatttcgatatttcacggaattttccaaccacattaacttgaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagccccttttatctgccccagttccacagaccccactaactggaattttacaacccaggcccattcctgcaggggaaactgtaattgttcctgaaaacctgctgagtaactcaggagttagaccagtaattctgataggctatggcactttaccctatttctatggaaatgttggtgacattgttgtgagtcctctgctggtgaattgctacaagattccacagttggaaaacaaagatttggaaaaattagggttgaccggcagccaatttctgagcgtggaaaacatgattcttctgacgatacagtatcttgtgcggctgggtcctgatcaggtacctctcagggaagaatttgagcaaattatgctgaaagctatgcaagaatttactctgagagaaagagccctgcagataggtgctcagtgtgtccctgtgtcaccaggacaactcccctggcttgctagattaattgccagcgtatctcaagacttggttcatgtggttgtgacccagaactctttggcggagggcatttcagagaccttaaggactctcagtgaaatgagacactatcaaaggctgccagattatgtggtggtaatttgtgcatcgaaaatcagaggaaatgaattttgtgtggtagtgttaggtcagcaccagtcccgagctctggcagagagcatgctcaccacaagtgagtttttgaaagaaattagttatgagcttatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctggatttagataatgaaaccttccacatttatcaaccgcagctaacagttgccagaaaactcttatcccaggtgtgtgctatagcggacagtggcagccagagcctggacctcggtcacttcagcaaagtagacttcatcatcattgttcccagatcggaggtgttggttcagcaaactcttcagcggattcgacaatcagtgtcatttcaggctctttgtcacatagcgaacccagtcatgggctagctgatagagtcattaattgcagagaagttctggaagctttcaacctcctggtgctccaggtcagctccttcccatacactctgcagacccaacagtcccgcattagctctagcaatgaggttcactggatacagctggatactggggaggacgtgggctgcgaggagaagctgtactttggcttgagtgagtacagcaagtctctgcagtgggggatcacgagcccacttctgagatgtgacgagacttttgaaaaaatggtgaacacactcttggagaggtaccccaggctgcacagcatggtcgtccgctgctatcttctcatccagcagtactctgaggccctgatggctctcaccaccatggcgtcactccgcgaccacagcacaccagaaacactcagcattatggatgacctcatcagctccccaggcaaaaacaaaagtgggaggggacacatgctcattatcagggtgccctcggtgcagctggcgatgttagccaaggagcggctacaggaggtgcgcgacaaactgggtctgcagtatcggtttgagatcatccttgggaacccggccaccgaactcagtgttgcaactcactttgtggcgcgattaaagagttggagaggaaatgaaccagaagagtggatccctcggacataccaagatttagacggtctaccttgtattgtgatattaactggcaaagatcctcttggagaaacctttcccaggtctttgaagtactgtgacctccggttaattgactcaagctatttaactcgcacggccttggagcaggaggtgggtctggcatgctgctatgtctcaaaagaggtcatccggggacccactgttgccctggacctcagcgggaaggagcaggagagagctgctgtcagtgagaatgactccgatgagctgctcatcgacctggagcggccccagagcaacagcagcgctgtcacagggacctcgggttccatcatggagaatggagtgagctcttccagcacagctgacaagtcccagaagcagtccctgacccccagctttcagagcccagccaccagcttggggctggatgaaggggtctccgccagctcagctggagccggagccggggagactctgaagcaggaatgtgactccctgggcccccagatggcgagcagcaccacctccaagccgtcatcatcatcctcaggacccaggaccctcccatggccgggacagcccatcagaggctgccggggcccacaggcagccctgccaccagtggtgatcctatccaaagcggcctacagtctcctgggctcccagaagagtggcaagctgccatcctcctcctccctgctgccccacgccgacgtggcctgggtgagctccctgcggccactcctgaacaaggacatgagcagtgaggagcagtccctctactacaggcagtggaccttggcccggcagcaccacgctgactatagcaaccagctggacccggcctctggcacccgaaacttccacccccgacggctcctgctgacagggcccccacaggtgggaaagacgggctcctatttacagttcctcaggatcctcttccgcatgctcatcaggctcctggaggtggacgtgtatgatgaggaggagatcaacaccgatcacaatgaaagcagtgaagtgagccagtcagagggagagccctggcctgacatcgagagcttcagtaaaatgccttttgatgtcagtgtgcatgaccccaagtacagtttgatgagcctggtgtatactgagaagctggcaggggtcaaacaagaagtgataaaggaatccaaagttgaagagcccaggaaacgggaaactgtatccataatgctgaccaaatatgcagcctataacacctttcaccactgtgaacagtgccgccagtacatggacttcacctctgcctcccagatgtctgactccacccttcatgccttcacattctcttcttctatgctgggagaagaggttcagctctatttcatcattcccaaatccaaagagagtcattttgtcttcagcaagcagggcaagcacctggagagcatgcggctgcccctggtttcagacaagaatttgaatgcagtcaagagccctattttcactccttccagtggtcgacatgagcacggactcctaaaccttttccacgccatggagggcatcagccaccttcacctcctggtggtcaaagagtatgagatgcctctgtaccgcaagtactggcccaaccacatcatgctggtgcttcccggcatgttcaataatgcaggcgtgggtgctgccaggttcctcatcaaggagctatcatatcacaacctagaattggagagaaaccgcctggaggagctaggcattaaacgccagtgtgtctggcctttcatcgtcatgatggatgactcatgtgtcctatggaacattcacagtgttcaggagccatccagccagcccatggaagtaggagtttccagtaagaatgtgtccttgaagactgtcttgcagcacattgaagccacaccaaaaattgtccactatgcaatcttgggcatacagaaatggagcagcaagctgacttctcagagcctaaaggccccattctctaggtgtcacgtgcatgatttcattctcctcaacacagacttgactcagaatgtgcagtatgacttcaacaggtatttctgtgaagatgctgactttaatctgagaacaaacagtagtggcctgctcatctgccgctttaataacttcagtctcatgaagaaacatgttcaggttggagggcaaagggactttatcattaaaccaaagatcatggtgtcagagagcttagcacccatcttgccccttcaatacatctgtgctcccgacagtgaacacacactactggcagcccctgcacagtttctcctggagaaattccttcagcacgcctcatataaactcttccccaaagccatccataacttcaggagtcctgtgctggccattgactgctaccttaacattggaccagaggtggccatatgctatatcagctccagaccccactccagcaatgtcaactgtgaaggggtgtttttcagtggactccttttgtacctctgtgactcttttgtaggtgctgatcttaagaaatttaaatttctaaaaggtgctacactgtgtgtcatctgccaagacagaagttccttgcgccaaacaattgtccgcttagagctagaagatgagtggcagttccgcctccgggacgagtttcaaactgctaacagcagtgatgacaagcctctctactttcttactggacgtcatgtatgagcttttgaa

SEQ ID NO: 2714 - DNA, 6052 bp, Homo sapiens
cagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgcacaaaaagctttaaacaagttaaaatctaggcaacagactccctgaagtgttgactgcccaacttaatcatgactgtgattcaaaaatgttaataaataaaccaaggtgtagatcatggggaattcatatgctgggcaactgaaatctgctcgatttgaggaagctctccacaactccatagaagcctccctcagatgtagtagtgtggtaccacggccaattttttcccagctatacctggaccctgaccagcatcctttctcatctgcagatgtcaaacccaaggtggaggatctggacaaagatttggtaaaccgctacactcaaaatggaagtctggatttttctaacaatctaacagttaatgaaatggaagatgatgaagacgatgaagaaatgtctgattcaaacagcccaccaattccctattcacaaaaacctgccccagaaggatcttgcactacagatggtttttgtcaagcaggaaaggatttgcgtttggtatcactgtgtatggaacaaattgacatcccagcaggattcctcctggtgggggccaagtctcccaatctgcctgaacacatcctagtttgtgctgtggacaagcgatttctaccagatgatcatggaaaaaatgcacttttagggttttctggaaattgtatcggctgtggagaaagaggatttcgatatttcacggaattttccaaccacattaacttgaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagccccttttatctgccccagttccacagaccccactaactggaattttacaacccaggcccattcctgcaggggaaactgtaattgttcctgaaaacctgctgagtaactcaggagttagaccagtaattctgataggctatggcactttaccctatttctatggaaatgttggtgacattgttgtgagtcctctgctggtgaattgctacaagattccacagttggaaaacaaagatttggaaaaattagggttgaccggcagccaatttctgagcgtggaaaacatgattcttctgacgatacagtatcttgtgcggctgggtcctgatcaggtacctctcagggaagaatttgagcaaattatgctgaaagctatgcaagaatttactctgagagaaagagccctgcagataggtgctcagtgtgtccctgtgtcaccaggacaactcccctggcttgctagattaattgccagcgtatctcaagacttggttcatgtggttgtgacccagaactctttggcggagggcatttcagagaccttaaggactctcagtgaaatgagacactatcaaaggctgccagattatgtggtggtaatttgtgcatcgaaaatcagaggaaatgaattttgtgtggtagtgttaggtcagcaccagtcccgagctctggcagagagcatgctcaccacaagtgagtttttgaaagaaattagttatgagcttatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctggatttagataatgaaaccttccacatttatcaaccgcagctaacagttgccagaaaactcttatcccaggtgtgtgctatagcggacagtggcagccagagcctggacctcggtcacttcagcaaagtagacttcatcatcattgttcccagatcggaggtgttggttcagcaaactcttcagcggattcgacaatcaggtgtccttgtagacttgggtctggaggaaaatgggacagcccatcagagagcagaaaaatatgttgttcgtctagacaatgagattcaaaccaagtttgaagtttttatgaggagagtgaaacagaacccgtacacactgtttgtgctagttcatgacaactcccatgtggaactaacgagtgtcatttcaggctctttgtcacatagcgaacccagtcatgggctagctgatagagtcattaattgcagagaagttctggaagctttcaacctcctggtgctccaggtcagctccttcccatacactctgcagacccaacagtcccgcattagctctagcaatgaggttcactggatacagctggatactggggaggacgtgggctgcgaggagaagctgtactttggcttgagtgagtacagcaagtctctgcagtgggggatcacgagcccacttctgagatgtgacgagacttttgaaaaaatggtgaacacactcttggagaggtaccccaggctgcacagcatggtcgtccgctgctatcttctcatccagcagtactctgaggccctgatggctctcaccaccatggcgtcactccgcgaccacagcacaccagaaacactcagcattatggatgacctcatcagctccccaggcaaaaacaaaagtgggaggggacacatgctcattatcagggtgccctcggtgcagctggcgatgttagccaaggagcggctacaggaggtgcgcgacaaactgggtctgcagtatcggtttgagatcatccttgggaacccggccaccgaactcagtgttgcaactcactttgtggcgcgattaaagagttggagaggaaatgaaccagaagagtggatccctcggacataccaagatttagacggtctaccttgtattgtgatattaactggcaaagatcctcttggagaaacctttcccaggtctttgaagtactgtgacctccggttaattgactcaagctatttaactcgcacggccttggagcaggaggtgggtctggcatgctgctatgtctcaaaagaggtcatccggggacccactgttgccctggacctcagcgggaaggagcaggagagagctgctgtcagtgagaatgactccgatgagctgctcatcgacctggagcggccccagagcaacagcagcgctgtcacagggacctcgggttccatcatggagaatggagtgagctcttccagcacagctgacaagtcccagaagcagtccctgacccccagctttcagagcccagccaccagcttggggctggatgaaggggtctccgccagctcagctggagccggagccggggagactctgaagcaggaatgtgactccctgggcccccagatggcgagcagcaccacctccaagccgtcatcatcatcctcaggacccaggaccctcccatggccgggacagcccatcagaggctgccggggcccacaggcagccctgccaccagtggtgatcctatccaaagcggcctacagtctcctgggctcccagaagagtggcaagctgccatcctcctcctccctgctgccccacgccgacgtggcctgggtgagctccctgcggccactcctgaacaaggacatgagcagtgaggagcagtccctctactacaggcagtggaccttggcccggcagcaccacgctgactatagcaaccagctggacccggcctctggcacccgaaacttccacccccgacggctcctgctgacagggcccccacaggtgggaaagacgggctcctatttacagttcctcaggatcctcttccgcatgctcatcaggctcctggaggtggacgtgtatgatgaggaggagatcaacaccgatcacaatgaaagcagtgaagtgagccagtcagagggagagccctggcctgacatcgagagcttcagtaaaatgccttttgatgtcagtgtgcatgaccccaagtacagtttgatgagcctggtgtatactgagaagctggcaggggtcaaacaagaagtgataaaggaatccaaagttgaagagcccaggaaacgggaaactgtatccataatgctgaccaaatatgcagcctataacacctttcaccactgtgaacagtgccgccagtacatggacttcacctctgcctcccagatgtctgactccacccttcatgccttcacattctcttcttctatgctgggagaagaggttcagctctatttcatcattcccaaatccaaagagagtcattttgtcttcagcaagcagggcaagcacctggagagcatgcggctgcccctggtttcagacaagaatttgaatgcagtcaagagccctattttcactccttccagtggtcgacatgagcacggactcctaaaccttttccacgccatggagggcatcagccaccttcacctcctggtggtcaaagagtatgagatgcctctgtaccgcaagtactggcccaaccacatcatgctggtgcttcccggcatgttcaataatgcaggcgtgggtgctgccaggttcctcatcaaggagctatcatatcacaacctagaattggagagaaaccgcctggaggagctaggcattaaacgccagtgtgtctggcctttcatcgtcatgatggatgactcatgtgtcctatggaacattcacagtgttcaggagccatccagccagcccatggaagtaggagtttccagtaagaatgtgtccttgaagactgtcttgcagcacattgaagccacaccaaaaattgtccactatgcaatcttgggcatacagaaatggagcagcaagctgacttctcagagcctaaaggccccattctctaggtgtcacgtgcatgatttcattctcctcaacacagacttgactcagaatgtgcagtatgacttcaacaggtatttctgtgaagatgctgactttaatctgagaacaaacagtagtggcctgctcatctgccgctttaataacttcagtctcatgaagaaacatgttcaggttggagggcaaagggactttatcattaaaccaaagatcatggtgtcagagagcttagcacccatcttgccccttcaatacatctgtgctcccgacagtgaacacacactactggcagcccctgcacagtttctcctggagaaattccttcagcacgcctcatataaactcttccccaaagccatccataacttcaggagtcctgtgctggccattgactgctaccttaacattggaccagaggtggccatatgctatatcagctccagaccccactccagcaatgtcaactgtgaaggggtgtttttcagtggactccttttgtacctctgtgactcttttgtaggtgctgatcttaagaaatttaaatttctaaaaggtgctacactgtgtgtcatctgccaagacagaagttccttgcgccaaacaattgtccgcttagagctagaagatgagtggcagttccgcctccgggacgagtttcaaactgctaacagcagtgatgacaagcctctctactttcttactggacgtcatgtatgagcttttgaa

SEQ ID NO: 2715 - DNA, 2515 bp, Homo sapiens
cagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgcacaaaaagctttaaacaagttaaaatctaggcaacagactccctgaagtgttgactgcccaacttaatcatgactgtgattcaaaaatgttaataaataaaccaaggtgtagatcatggggaattcatatgctgggcaactgaaatctgctcgatttgaggaagctctccacaactccatagaagcctccctcagatgtagtagtgtggtaccacggccaattttttcccagctatacctggaccctgaccagcatcctttctcatctgcagatgtcaaacccaaggtggaggatctggacaaagatttggtaaaccgctacactcaaaatggaagtctggatttttctaacaatctaacagttaatgaaatggaagatgatgaagacgatgaagaaatgtctgattcaaacagcccaccaattccctattcacaaaaacctgccccagaaggatcttgcactacagatggtttttgtcaagcaggaaaggatttgcgtttggtatcactgtgtatggaacaaattgacatcccagcaggattcctcctggtgggggccaagtctcccaatctgcctgaacacatcctagtttgtgctgtggacaagcgatttctaccagatgatcatggaaaaaatgcacttttagggttttctggaaattgtatcggctgtggagaaagaggatttcgatatttcacggaattttccaaccacattaacttgaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagccccttttatctgccccagttccacagaccccactaactggaattttacaacccaggcccattcctgcaggggaaactgtaattgttcctgaaaacctgctgagtaactcaggagttagaccagtaattctgataggctatggcactttaccctatttctatggaaatgttggtgacattgttgtgagtcctctgctggtgaattgctacaagattccacagttggaaaacaaagatttggaaaaattagggttgaccggcagccaatttctgagcgtggaaaacatgattcttctgacgatacagtatcttgtgcggctgggtcctgatcaggtacctctcagggaagaatttgagcaaattatgctgaaagctatgcaagaatttactctgagagaaagagccctgcagataggtgctcagtgtgtccctgtgtcaccaggacaactcccctggcttgctagattaattgccagcgtatctcaagacttggttcatgtggttgtgacccagaactctttggcggagggcatttcagagaccttaaggactctcagtgaaatgagacactatcaaaggctgccagattatgtggtggtaatttgtgcatcgaaaatcagaggaaatgaattttgtgtggtagtgttaggtcagcaccagtcccgagctctggcagagagcatgctcaccacaagtgagtttttgaaagaaattagttatgagcttatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctggatttagataatgaaaccttccacatttatcaaccgcagctaacagttgccagaaaactcttatcccaggtgtgtgctatagcggacagtggcagccagagcctggacctcggtcacttcagcaaagtagacttcatcatcattgttcccagatcggaggtgttggttcagcaaactcttcagcggattcgacaatcaggttccagtccaggttcacacattgcattcagttatgtcctcttcatctcctgcaatctatga

SEQ ID NO: 2716 - DNA, 1173 bp, Homo sapiens
ggcagctgagtcagtgagcagcgccatgatgaggggcagtccctgccagcaccaacaggggctggaaacccagcgataggagcatcagcatctccgaggggtcctgtggctgtctgtggtctccgaggtgctgtacattctgctgctggtggttggcttcagcctcatgtgtctcgagctcttccactccagcaatgtcatcgacgggctcaagctcaatgccttcgcggctgtcttcacggtgctctcaggcctcctgggaatggtcgcccacatgatgtacacgcaggtgttccaggtcaccgtgagcctcggtcctgaggactggagaccccattcctgggactacgggtggtccttctgcctggcgtggggctcctttacctgctgcatggcagcctctgtcaccacgctcaactcctacaccaagacggtcattgagttccggcacaagcgcaaggtctttgagcagggctaccgggaagagccgaccttcatagaccctgaggccatcaagtacttccgggagaggatggagaagagggacgggagcgaggaggactttcacttagactgccgccacgagagataccctgcccgacaccagccacacatggcggattcctggccccggagctccgcacaggaagcaccagagctgaaccgacagtgctgggtcttggggcactgggtgtgaccaagacctcaacctggcccgcggacctcaggccatcgctggcaccagcccctgctgcaagaccaccagagtggtgcccccagaaccctggcctgtgtgccgtgaactcagtcagcctgcgtgggagatgccaggcctgtcctgcccatcgctgcctgggtcccatggccttggaaatggggccagggcaggcccaagggaatgcacagggctgcacagagtgactttgggacagcagccccggactcttgccatcatcacatgagccctgctgggcacagctgcgatgccaggagacacatggccactggccactgaatggctggcacccacaagccagtcaggtgcccagaggggcagagccctttggggggcagagagtggcttcctgaaggagggggcagtggcgcaggcactgcaggggtgtcacacagcaggcacacagcaggggctcaataaatgcttgttgaacttgt

SEQ ID NO: 2717 - DNA, 4976 bp, Homo sapiens
gcggccgctgacgcggggcgccagctgccaacttcgcgcgcggagctccccggcggtgcagtcccgtcccggcggcgcgggcggcatgaagactagccgccgcggccgagcgctcctggccgtggccctgaacctgctggcgctgctgttcgccaccaccgctttcctcaccacgcactggtgccagggcacgcagcgggtccccaagccgggctgcggccagggcgggcgcgccaactgccccaactcgggcgccaacgccacggccaacggcaccgccgcccccgccgccgccgccgccgccgccaccgcctcggggaacggcccccctggcggcgcgctctacagctgggagaccggcgacgaccgcttcctcttcaggaatttccacaccggcatctggtactcgtgcgaggaggagctcagcgggcttggtgaaaaatgtcgcagcttcattgacctggccccggcatcggagaaaggggtcctgtggctgtctgtggtctccgaggtgctgtacattctgctgctggtggttggcttcagcctcatgtgtctcgagctcttccactccagcaatgtcatcgacgggctcaagctcaatgccttcgcggctgtcttcacggtgctctcaggcctcctgggaatggtcgcccacatgatgtacacgcaggtgttccaggtcaccgtgagcctcggtcctgaggactggagaccccattcctgggactacgggtggtccttctgcctggcgtggggctcctttacctgctgcatggcagcctctgtcaccacgctcaactcctacaccaagacggtcattgagttccggcacaagcgcaaggtctttgagcagggctaccgggaagagccgaccttcatagaccctgaggccatcaagtacttccgggagaggtggcaaatcgaggcacagagagggagggcgacttgccccaggtcacacagctggatggagaagagggacgggagcgaggaggactttcacttagactgccgccacgagagataccctgcccgacaccagccacacatggcggattcctggccccggagctccgcacaggaagcaccagagctgaaccgacagtgctgggtcttggggcactgggtgtgaccaagacctcaacctggcccgcggacctcaggccatcgctggcaccagcccctgctgcaagaccaccagagtggtgcccccagaaccctggcctgtgtgccgtgaactcagtcagcctgcgtgggagatgccaggcctgtcctgcccatcgctgcctgggtcccatggccttggaaatggggccagggcaggcccaagggaatgcacagggctgcacagagtgactttgggacagcagccccggactcttgccatcatcacatgagccctgctgggcacagctgcgatgccaggagacacatggccactggccactgaatggctggcacccacaagccagtcaggtgcccagaggggcagagccctttggggggcagagagtggcttcctgaaggagggggcagtggcgcaggcactgcaggggtgtcacacagcaggcacacagcaggggctcaataaatgcttgttgaacttgttttcttgcggtgtatggaggccagttgctctgtgggctgtggctgccctgtcattgccccaccccattactcctcaaggaggctgaaggtgacagcagagactgtgcagaggccagggccagacactgcagggtggcagggagggagcacagagcccaggctggacacaggctggcagggctgccttgtattccagagagtgggcaaggcaggggccaggcaagcaagagatgtggggcgagcaagaagtgggcccccaaacccaagccctaagcagggagggtgaagaagccacatttctcttcagagctcagcaacatcacaccaccctgaccctgaggaggctttaccctgtgcctagcaccacctttacagaaaatcccagggcttagatgcctggagaaacagattcttattataaagaggaggaaaattagggtcacagagatgaatgaagtaacttgcctgtgattacagagctagcaaatggcagagatggggtttgaatcaggactcctgactccaagttcagtcatttcccaagaggccttattccttcccagaagaatttctagagcttttccccacgtagaatatattcttctcctttatccttccatccttccatccatcatccatcactcatccagccattatccattatccatccatccattcatcattcgtccatctattatccacccattcatcatctattatccatccatcattcatcatccatccatcattcataattcatctttccactcatccatccatcattcattcattcatccatccttccatccatccatcatctatccattcatccatccatttgccatccatccactcattcatcagctatccatcatctatccatccatccatccatccagcatctatcactcatccagctattgtccattgtccattcatccatttttcattcatccctccatcatcattaatccattatccacccactcatcatctattatccatctatagtccatcaaccatccatccttcatcatccatccatccatccttcatccatccatccacccatccatccatccatcatctgtccatccattatctatccattcatccatccattcatcatccacccacctattcatcagctatctatccatcatccatccatccatcatccatccatccatccatccatccatcatctatccattcattgtctatgctttcatccatccattcatcatccatccacccattcgttagctatttatccattatccattcctccatctatccatcatccattcatcccttatccattcaaccattatgcatttcttcatttatccattatttatccttccatccatcatccatcatctttccatccactatctatccattcatccatctatccatcatccatccatcctttatccatcattcatcagccatcatccctccatctatccattatccatcatccactcatccattcatccctccatctgcccattatccatcaaccatccatccatccattatccgtcatccacacatccattcatccctccatctgcccattatccatcaaccatccatccatccattatccatttctgcattatccatttattctttatccatttcttcatctattcatcatctatccatccattatccttacacctatctatcatccatccattccttcatctatccatcatccatcaattatccatccattcatccatccatctatccatcttctattgattgcttgtcatccttccttgtatcagacttccatccatcctccttccatgtgtcacacatcctcattactcaaccatccagctgtgcatccatctattcactgatatagttcactgtgcccctactatgtgccaagcactgtggtaggcacttgaggtgggatgctggagcatccagagagggcatctattgtcgtgagcctgggttcagattccaccttctccacttgtgaccttgggcgagttacttgacctttctgtgcctgtttcctcatccattaaatccggataatcattatacctacctcttcaagctgttgtgcaaattaaatgagctaacatatttgaagtgtctagaacagagcctggcacaagtaaacactttgtgggtgtttactaacaggacaacaaggggaaatcggggctgtgggagctgtagtctagggaggctcctttgagaaaatgatgtctaagccaagacatgaagattgtctgggcatcagccaggcaagagtatagcagggaaagaaagtacattagaggactttaaaatagtcccaatggcaggtgtggagagcagggaggtcaggaggcagttgtgggaaattaggcatcagagggcagtggagccaggccaggaggaactggaaaccttcttagggagcttagagtttaccctggggcaatggggagtgggcagtgagatgcttttagcagactgggatgcgcctgggtgtacatttgaggaagatcaccgcaactatgggcacagaatagttgtgggagatgcttctcccttcctcatccctcttacactcaagaaagagaagaaagtgggctggcttaggaaagttgccctggggaggggaccatgcgggcagattcaggaaccaattaggagggaatagactgagtgggagaagaggaaagttggtgacgactctcaggttacagggtcagcttgggggatagggaagacggagacttcgtggttcagatgtcttgagtctcaggggctcaggggacagccagctggaggtttgtgctcattcattcacgcattgattcatcaagcgaacaatttgttaattcactttccattcattcagtaaatattaatgacctactaggtggggcttaaggcggggctggaaatgggcctgggagagcaattatggtccagctctactgaggccttgaatgtcagaacaaggaatttgggctttggcctcatgcaagagagggcggctgccatatatgggcctgggcagggacagatctgacagggatctagccctggccaccaggcatctaggagctcttgttctcacccagggtccttctgaagttggcgagtggaccgcaggaggtccaggagatgattgtagttgacacatggggaaaattttaatctattttaatagttgtgtttatgtaaatgtgtattagaaaaaaatgtacagtgggcacatcagtgctatgacttcacagacgttactgcttaggatgaaaccaaaataggcatttaagtaaaagaaaaaaagagttggcttaaagaaaaatattaaataaataatcgtgcaagtg

SEQ ID NO: 2718 - DNA, 4769 bp, Homo sapiens
gcggccgctgacgcggggcgccagctgccaacttcgcgcgcggagctccccggcggtgcagtcccgtcccggcggcgcgggcggcatgaagactagccgccgcggccgagcgctcctggccgtggccctgaacctgctggcgctgctgttcgccaccaccgctttcctcaccacgcactggtgccagggcacgcagcgggtccccaagccgggctgcggccagggcgggcgcgccaactgccccaactcgggcgccaacgccacggccaacggcaccgccgcccccgccgccgccgccgccgccgccaccgcctcggggaacggcccccctggcggcgcgctctacagctgggagaccggcgacgaccgcttcctcttcaggaatttccacaccggcatctggtactcgtgcgaggaggagctcagcgggcttggtgaaaaatgtcgcagcttcattgacctggccccggcatcggagaaaggcctcctgggaatggtcgcccacatgatgtacacgcaggtgttccaggtcaccgtgagcctcggtcctgaggactggagaccccattcctgggactacgggtggtccttctgcctggcgtggggctcctttacctgctgcatggcagcctctgtcaccacgctcaactcctacaccaagacggtcattgagttccggcacaagcgcaaggtctttgagcagggctaccgggaagagccgaccttcatagaccctgaggccatcaagtacttccgggagaggatggagaagagggacgggagcgaggaggactttcacttagactgccgccacgagagataccctgcccgacaccagccacacatggcggattcctggccccggagctccgcacaggaagcaccagagctgaaccgacagtgctgggtcttggggcactgggtgtgaccaagacctcaacctggcccgcggacctcaggccatcgctggcaccagcccctgctgcaagaccaccagagtggtgcccccagaaccctggcctgtgtgccgtgaactcagtcagcctgcgtgggagatgccaggcctgtcctgcccatcgctgcctgggtcccatggccttggaaatggggccagggcaggcccaagggaatgcacagggctgcacagagtgactttgggacagcagccccggactcttgccatcatcacatgagccctgctgggcacagctgcgatgccaggagacacatggccactggccactgaatggctggcacccacaagccagtcaggtgcccagaggggcagagccctttggggggcagagagtggcttcctgaaggagggggcagtggcgcaggcactgcaggggtgtcacacagcaggcacacagcaggggctcaataaatgcttgttgaacttgttttcttgcggtgtatggaggccagttgctctgtgggctgtggctgccctgtcattgccccaccccattactcctcaaggaggctgaaggtgacagcagagactgtgcagaggccagggccagacactgcagggtggcagggagggagcacagagcccaggctggacacaggctggcagggctgccttgtattccagagagtgggcaaggcaggggccaggcaagcaagagatgtggggcgagcaagaagtgggcccccaaacccaagccctaagcagggagggtgaagaagccacatttctcttcagagctcagcaacatcacaccaccctgaccctgaggaggctttaccctgtgcctagcaccacctttacagaaaatcccagggcttagatgcctggagaaacagattcttattataaagaggaggaaaattagggtcacagagatgaatgaagtaacttgcctgtgattacagagctagcaaatggcagagatggggtttgaatcaggactcctgactccaagttcagtcatttcccaagaggccttattccttcccagaagaatttctagagcttttccccacgtagaatatattcttctcctttatccttccatccttccatccatcatccatcactcatccagccattatccattatccatccatccattcatcattcgtccatctattatccacccattcatcatctattatccatccatcattcatcatccatccatcattcataattcatctttccactcatccatccatcattcattcattcatccatccttccatccatccatcatctatccattcatccatccatttgccatccatccactcattcatcagctatccatcatctatccatccatccatccatccagcatctatcactcatccagctattgtccattgtccattcatccatttttcattcatccctccatcatcattaatccattatccacccactcatcatctattatccatctatagtccatcaaccatccatccttcatcatccatccatccatccttcatccatccatccacccatccatccatccatcatctgtccatccattatctatccattcatccatccattcatcatccacccacctattcatcagctatctatccatcatccatccatccatcatccatccatccatccatccatccatcatctatccattcattgtctatgctttcatccatccattcatcatccatccacccattcgttagctatttatccattatccattcctccatctatccatcatccattcatcccttatccattcaaccattatgcatttcttcatttatccattatttatccttccatccatcatccatcatctttccatccactatctatccattcatccatctatccatcatccatccatcctttatccatcattcatcagccatcatccctccatctatccattatccatcatccactcatccattcatccctccatctgcccattatccatcaaccatccatccatccattatccgtcatccacacatccattcatccctccatctgcccattatccatcaaccatccatccatccattatccatttctgcattatccatttattctttatccatttcttcatctattcatcatctatccatccattatccttacacctatctatcatccatccattccttcatctatccatcatccatcaattatccatccattcatccatccatctatccatcttctattgattgcttgtcatccttccttgtatcagacttccatccatcctccttccatgtgtcacacatcctcattactcaaccatccagctgtgcatccatctattcactgatatagttcactgtgcccctactatgtgccaagcactgtggtaggcacttgaggtgggatgctggagcatccagagagggcatctattgtcgtgagcctgggttcagattccaccttctccacttgtgaccttgggcgagttacttgacctttctgtgcctgtttcctcatccattaaatccggataatcattatacctacctcttcaagctgttgtgcaaattaaatgagctaacatatttgaagtgtctagaacagagcctggcacaagtaaacactttgtgggtgtttactaacaggacaacaaggggaaatcggggctgtgggagctgtagtctagggaggctcctttgagaaaatgatgtctaagccaagacatgaagattgtctgggcatcagccaggcaagagtatagcagggaaagaaagtacattagaggactttaaaatagtcccaatggcaggtgtggagagcagggaggtcaggaggcagttgtgggaaattaggcatcagagggcagtggagccaggccaggaggaactggaaaccttcttagggagcttagagtttaccctggggcaatggggagtgggcagtgagatgcttttagcagactgggatgcgcctgggtgtacatttgaggaagatcaccgcaactatgggcacagaatagttgtgggagatgcttctcccttcctcatccctcttacactcaagaaagagaagaaagtgggctggcttaggaaagttgccctggggaggggaccatgcgggcagattcaggaaccaattaggagggaatagactgagtgggagaagaggaaagttggtgacgactctcaggttacagggtcagcttgggggatagggaagacggagacttcgtggttcagatgtcttgagtctcaggggctcaggggacagccagctggaggtttgtgctcattcattcacgcattgattcatcaagcgaacaatttgttaattcactttccattcattcagtaaatattaatgacctactaggtggggcttaaggcggggctggaaatgggcctgggagagcaattatggtccagctctactgaggccttgaatgtcagaacaaggaatttgggctttggcctcatgcaagagagggcggctgccatatatgggcctgggcagggacagatctgacagggatctagccctggccaccaggcatctaggagctcttgttctcacccagggtccttctgaagttggcgagtggaccgcaggaggtccaggagatgattgtagttgacacatggggaaaattttaatctattttaatagttgtgtttatgtaaatgtgtattagaaaaaaatgtacagtgggcacatcagtgctatgacttcacagacgttactgcttaggatgaaaccaaaataggcatttaagtaaaagaaaaaaagagttggcttaaagaaaaatattaaataaataatcgtgcaagtg

SEQ ID NO: 2719 - DNA, 4922 bp, Homo sapiens
gcggccgctgacgcggggcgccagctgccaacttcgcgcgcggagctccccggcggtgcagtcccgtcccggcggcgcgggcggcatgaagactagccgccgcggccgagcgctcctggccgtggccctgaacctgctggcgctgctgttcgccaccaccgctttcctcaccacgcactggtgccagggcacgcagcgggtccccaagccgggctgcggccagggcgggcgcgccaactgccccaactcgggcgccaacgccacggccaacggcaccgccgcccccgccgccgccgccgccgccgccaccgcctcggggaacggcccccctggcggcgcgctctacagctgggagaccggcgacgaccgcttcctcttcaggaatttccacaccggcatctggtactcgtgcgaggaggagctcagcgggcttggtgaaaaatgtcgcagcttcattgacctggccccggcatcggagaaaggggtcctgtggctgtctgtggtctccgaggtgctgtacattctgctgctggtggttggcttcagcctcatgtgtctcgagctcttccactccagcaatgtcatcgacgggctcaagctcaatgccttcgcggctgtcttcacggtgctctcaggcctcctgggaatggtcgcccacatgatgtacacgcaggtgttccaggtcaccgtgagcctcggtcctgaggactggagaccccattcctgggactacgggtggtccttctgcctggcgtggggctcctttacctgctgcatggcagcctctgtcaccacgctcaactcctacaccaagacggtcattgagttccggcacaagcgcaaggtctttgagcagggctaccgggaagagccgaccttcatagaccctgaggccatcaagtacttccgggagaggatggagaagagggacgggagcgaggaggactttcacttagactgccgccacgagagataccctgcccgacaccagccacacatggcggattcctggccccggagctccgcacaggaagcaccagagctgaaccgacagtgctgggtcttggggcactgggtgtgaccaagacctcaacctggcccgcggacctcaggccatcgctggcaccagcccctgctgcaagaccaccagagtggtgcccccagaaccctggcctgtgtgccgtgaactcagtcagcctgcgtgggagatgccaggcctgtcctgcccatcgctgcctgggtcccatggccttggaaatggggccagggcaggcccaagggaatgcacagggctgcacagagtgactttgggacagcagccccggactcttgccatcatcacatgagccctgctgggcacagctgcgatgccaggagacacatggccactggccactgaatggctggcacccacaagccagtcaggtgcccagaggggcagagccctttggggggcagagagtggcttcctgaaggagggggcagtggcgcaggcactgcaggggtgtcacacagcaggcacacagcaggggctcaataaatgcttgttgaacttgttttcttgcggtgtatggaggccagttgctctgtgggctgtggctgccctgtcattgccccaccccattactcctcaaggaggctgaaggtgacagcagagactgtgcagaggccagggccagacactgcagggtggcagggagggagcacagagcccaggctggacacaggctggcagggctgccttgtattccagagagtgggcaaggcaggggccaggcaagcaagagatgtggggcgagcaagaagtgggcccccaaacccaagccctaagcagggagggtgaagaagccacatttctcttcagagctcagcaacatcacaccaccctgaccctgaggaggctttaccctgtgcctagcaccacctttacagaaaatcccagggcttagatgcctggagaaacagattcttattataaagaggaggaaaattagggtcacagagatgaatgaagtaacttgcctgtgattacagagctagcaaatggcagagatggggtttgaatcaggactcctgactccaagttcagtcatttcccaagaggccttattccttcccagaagaatttctagagcttttccccacgtagaatatattcttctcctttatccttccatccttccatccatcatccatcactcatccagccattatccattatccatccatccattcatcattcgtccatctattatccacccattcatcatctattatccatccatcattcatcatccatccatcattcataattcatctttccactcatccatccatcattcattcattcatccatccttccatccatccatcatctatccattcatccatccatttgccatccatccactcattcatcagctatccatcatctatccatccatccatccatccagcatctatcactcatccagctattgtccattgtccattcatccatttttcattcatccctccatcatcattaatccattatccacccactcatcatctattatccatctatagtccatcaaccatccatccttcatcatccatccatccatccttcatccatccatccacccatccatccatccatcatctgtccatccattatctatccattcatccatccattcatcatccacccacctattcatcagctatctatccatcatccatccatccatcatccatccatccatccatccatccatcatctatccattcattgtctatgctttcatccatccattcatcatccatccacccattcgttagctatttatccattatccattcctccatctatccatcatccattcatcccttatccattcaaccattatgcatttcttcatttatccattatttatccttccatccatcatccatcatctttccatccactatctatccattcatccatctatccatcatccatccatcctttatccatcattcatcagccatcatccctccatctatccattatccatcatccactcatccattcatccctccatctgcccattatccatcaaccatccatccatccattatccgtcatccacacatccattcatccctccatctgcccattatccatcaaccatccatccatccattatccatttctgcattatccatttattctttatccatttcttcatctattcatcatctatccatccattatccttacacctatctatcatccatccattccttcatctatccatcatccatcaattatccatccattcatccatccatctatccatcttctattgattgcttgtcatccttccttgtatcagacttccatccatcctccttccatgtgtcacacatcctcattactcaaccatccagctgtgcatccatctattcactgatatagttcactgtgcccctactatgtgccaagcactgtggtaggcacttgaggtgggatgctggagcatccagagagggcatctattgtcgtgagcctgggttcagattccaccttctccacttgtgaccttgggcgagttacttgacctttctgtgcctgtttcctcatccattaaatccggataatcattatacctacctcttcaagctgttgtgcaaattaaatgagctaacatatttgaagtgtctagaacagagcctggcacaagtaaacactttgtgggtgtttactaacaggacaacaaggggaaatcggggctgtgggagctgtagtctagggaggctcctttgagaaaatgatgtctaagccaagacatgaagattgtctgggcatcagccaggcaagagtatagcagggaaagaaagtacattagaggactttaaaatagtcccaatggcaggtgtggagagcagggaggtcaggaggcagttgtgggaaattaggcatcagagggcagtggagccaggccaggaggaactggaaaccttcttagggagcttagagtttaccctggggcaatggggagtgggcagtgagatgcttttagcagactgggatgcgcctgggtgtacatttgaggaagatcaccgcaactatgggcacagaatagttgtgggagatgcttctcccttcctcatccctcttacactcaagaaagagaagaaagtgggctggcttaggaaagttgccctggggaggggaccatgcgggcagattcaggaaccaattaggagggaatagactgagtgggagaagaggaaagttggtgacgactctcaggttacagggtcagcttgggggatagggaagacggagacttcgtggttcagatgtcttgagtctcaggggctcaggggacagccagctggaggtttgtgctcattcattcacgcattgattcatcaagcgaacaatttgttaattcactttccattcattcagtaaatattaatgacctactaggtggggcttaaggcggggctggaaatgggcctgggagagcaattatggtccagctctactgaggccttgaatgtcagaacaaggaatttgggctttggcctcatgcaagagagggcggctgccatatatgggcctgggcagggacagatctgacagggatctagccctggccaccaggcatctaggagctcttgttctcacccagggtccttctgaagttggcgagtggaccgcaggaggtccaggagatgattgtagttgacacatggggaaaattttaatctattttaatagttgtgtttatgtaaatgtgtattagaaaaaaatgtacagtgggcacatcagtgctatgacttcacagacgttactgcttaggatgaaaccaaaataggcatttaagtaaaagaaaaaaagagttggcttaaagaaaaatattaaataaataatcgtgcaagtg

SEQ ID NO: 2720 - DNA, 2571 bp, Homo sapiens
ggccccctgcccagacttgaagccacacaggcaggtcgggcaggcgggtcgcaggttgtaaatccatgtggcgggggctttggaccctggcggcccaagcggcacgtgggcctcgcagattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcacagcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaagccgacatcgaagtacgggcactgcaggtggccctgggtgcacatctacgagatgccaggcgcgggcagaggctccgctcaggggtgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagaggctagagcaggctgacctcattctggccatgctggatgcttctgacctggcctctccctccagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtatatttgtttcgtagttttttatttattttgcaaataccaaaggaatgtaaaaaaaactcaggtgatctagaagtgtttattttcttcccttcccttcccttccctttccttttccctttccctttccccttccccttccccttccccttcccctacccttccctcctctgtctattgcccaggctggagtgcagtggtgcgaccttggctcactgcaacctccatctccggggctcaagcgcttctcctgcctcagcctcctgagtagctgggattacaggcatgtgccagcatgcccggctaatttttttctttttttgagacagagtctcgctctgtcacccaggctggagttcagtggtgcgacctcggcttactgcaacctccacctcccgggttcaagtgattctcctgcctcagcctcttgagtagctgggactacaggcgcacaccaccacgccaggctaatttttgtatttttagtagagacaaggtttcaccatgttgaccaggctggtcttgaactccttgacctcaggtaatctgcctaccttggcctcccaaagtgctgggatcacaggcgtgagctatcacacctggccccagaagtgtttcaacatggaaattttccttagcccttctgtggttgtcatggcttaatgtgtgtctttccagaactttgaatgtttgcatacttgtggatgtacctttcaaatatgtttgtcttgtgtatcatatataaatggtattgtgttcattgctct

SEQ ID NO: 2721 - DNA, 1913 bp, Homo sapiens
ggcaggcgggtcgcaggttgtaaatccatgtggcgggggctttggaccctggcggcccaagcggcacgtgggcctcgcagattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcacagcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaaggtgggtctacctggtggtgggggaggaagacacctcatatcagccctcaaaggctcccctcactgtctctctctgcctgccttctctcacccacagccgacatcgaagtacgggcactgcaggtggccctgggtgcacatctacgagatgccaggcgcgggcagaggctccgctcaggggtgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagaggctagagcaggctgacctcattctggccatgctggatgcttctgacctggcctctccctccagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtatatttgtttcgtagttttttatttattttgcaaataccaaaggaatgt

SEQ ID NO: 2722 - DNA, 1814 bp, Homo sapiens
actgatggtgcattctccaacttgtccccacccatgctttcttctggtccccgcctcggagcctcagtttccccatctgcaaactccggaccctggagacgctgtttggaatgtgagatgggcattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcacagcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaagccgacatcgaagtacgggcactgcaggtggccctgggtgcacatctacgagatgccaggcgcgggcagaggctccgctcaggggtgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagaggctagagcaggctgacctcattctggccatgctggatgcttctgacctggcctctccctccagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtata

SEQ ID NO: 2723 - DNA, 483 bp, Homo sapiens
ggcaggcgggtcgcaggttgtaaatccatgtggcgggggctttggaccctggcggcccaagcggcacgtgggcctcgcagattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcacagcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggagccaggcgcgggcagaggctccgctcaggggtgcacgtag

SEQ ID NO: 2724 - DNA, 2493 bp, Homo sapiens
gcccagacttgaagccacacaggcaggtcgggcaggcgggtcgcaggttgtaaatccatgtggcgggggctttggaccctggcggcccaagcggcacgtgggcctcgcagattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcacagcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaagccgacatcgaagtacgggcactgcaggtggccctgggtgcacatctacgagatgccaggcgcgggcagaggctccgctcaggggtgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtatatttgtttcgtagttttttatttattttgcaaataccaaaggaatgtaaaaaaaactcaggtgatctagaagtgtttattttcttcccttcccttcccttccctttccttttccctttccctttccccttccccttccccttccccttcccctacccttccctcctctgtctattgcccaggctggagtgcagtggtgcgaccttggctcactgcaacctccatctccggggctcaagcgcttctcctgcctcagcctcctgagtagctgggattacaggcatgtgccagcatgcccggctaatttttttctttttttgagacagagtctcgctctgtcacccaggctggagttcagtggtgcgacctcggcttactgcaacctccacctcccgggttcaagtgattctcctgcctcagcctcttgagtagctgggactacaggcgcacaccaccacgccaggctaatttttgtatttttagtagagacaaggtttcaccatgttgaccaggctggtcttgaactccttgacctcaggtaatctgcctaccttggcctcccaaagtgctgggatcacaggcgtgagctatcacacctggccccagaagtgtttcaacatggaaattttccttagcccttctgtggttgtcatggcttaatgtgtgtctttccagaactttgaatgtttgcatacttgtggatgtacctttcaaatatgtttgtcttgtgtatcatatataaatggtattgtgttca

SEQ ID NO: 2725 - DNA, 756 bp, Homo sapiens
gggtccaccagagatcggatcccccagagaccggggtccacctaagaccgtggtccacccaaagactgagggcccccagagatgggggtacacccagagttgggttccctggaggggccccgggtgacgatgtgggcgagtggagggggaccccgacatgtgagggaggaagcgttccgtggtccgtgatgagccttcggattctgggtttggcgtagccccctcccctctcaggaatcctgggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaag

SEQ ID NO: 2726 - DNA, 4696 bp, Homo sapiens
cgcccgacagtggaagtcccacctgcgcccgacggcggaagttccgggagtgccaagtacccgcgtgcatacggctgccggcatggcacattacaacttcaagaaaattacggtggtgccgtccgccaaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggttcagaggacagttttggagaaggagatgcgtagtcttggtgttgacatggacgataaagacgatgcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtttaactaggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagtagttttcatttacttagctcatgttttggtttagttatagtcgctatggatttggccaaataaaaaggcaaacaacatgacatttctattttgttttaaagcaaaaatacttttgggggagtaaaatgttgctggaggcattaggcaattaaatatgggcattctcctatttctgtggcccgtccctgaagttacatgttcagtaaaacacaaaaacaccgccaatgccacctcaaaagcacctgctggggagcgttggggtgaagagctgtggggtcggagggacctgcccaggggtccgtgtgctcctggagctccaaagacacacaggggtccaagagccaccacggataagttatcaagtcacacaatcaacattatagctgaggaaaggactttagttaatcacacttctggattacatgtggcaattttaaaaatttaccagggctgggctgggcgcaggggctcaagcctgtagttccagcactttgggaggccgaggtgggcagatcaggaggtcaggagttcgagaccagcctggccaacatggtgaaaccccatctctactaaaaatacaaaaattagccatgcgtggtggtgggcatctgtaatcctagctgctcgggaggctaaggcaggagaattgcttgagcccagaggcggaggttgcagtgagccgagatcgtgccactgcactccagcctgggtgacagagagagactccgtgtgaaaaaaaaaaaaaaaataccaggtctggtttttgaaattctttctccgtattaaacaccaaaacttaacatatagtttactttgtgttaaacaacaacagtatggccgggcgcggcagctcatgcctgtaatcccagcactttgggaggccgaggcaggcggatcacgaggtcaggagatcgagaccatcctggctaacacggtgaaaccccgtctctactaaaaatacaaaaaattagctgggtgtggtggcgggcgcctgtagtcccaactacttgggaggctgaggcaggagaatggcttgaacccgggaggcggagcttgcagtgagccaagatcgcaccactgcactccagcctggtcgacagcgagactccatctcaaaaaaaaaaaaaaaataccaggtctggtttttgaaattctttctccgtattaaacaccaaaacttaacatatagtttactttgtgttaaacaacaacagtatgttttaaagcaagtatgtctttatttgtaagcatattactgaaacgatcaaatgaacagaagtggataaacgtcgagtcacttggctgagaccatacgcatcttccgtactgcttgtattaggatgcaagattgaatgtgtcttttttttaaaaatgcagccttgtgttgcactctgaaataagtgatttaaaaagaaaaacatgatacagagatcccatcctgaccttggaggcttggataaagctgtggggagacagcctcatggtccagccaggctagtccgcctgcttcaggactctcaagatctccccaagactttcaggatcagctgctgttaatcaaacaagtgcttataaaatggaaattgggacaaaggaaatgttaaatttcctccctgcaaccaggcagatgagaaatatggaaataaggaaaagggaaaatgaagatatgacaaagttgatgaaaaggttgaaatagtgatttatacatgatgggcaatcaagtgccccttttgccctgttttttggagagggtgtatcattgcctcaatggtgcgtctgcctgcactgagggcattacacatggctgactcgacctccctgcctctcacactctgtgtattttgtgaagctccacaaacggggtcacgtcatccaggtgaggccaccaccggtacagaaacctctcggcaatggttcttagccagggggtgactttgacttcacccctcgcctccctctccagcagctcccacagctcctcctgggacaggtagaggatgcttttcgtttcactgggatccgggttcagagtgacgtttttcctcacaagcagaaggtaacaaatttcatgctctccccaaattctgtctgattttgccttgtggtgatagattgtcatgaacacaatgtcctctggagaaatctattgacagaaattggtgcagtgttaacaacgctaatgtaaaacacagaatttacagaaaaatagagaaaataaacacatttgttttcctcagaaaatgaa

SEQ ID NO: 2727 - DNA, 2269 bp, Homo sapiens
gtgcatacggctgccggcatggcacattacaacttcaagaaaattacggtggtgccgtccgccaaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggattgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggttcagaggacagttttggagaaggagatgcgtagtcttggtgttgacatggacgataaagacgatgcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtttaactaggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaac

SEQ ID NO: 2728 - DNA, 2566 bp, Homo sapiens
agagatcggatcccccagagaccggggtccacctaagaccgtggtccacccaaagactgagggcccccagagatgggggtacacccagagttgggttccctggaggggccccgggtgacgatgtgggcgagtggagggggaccccgacatgtgagggaggaagcgttccgtggtccgtgatgagccttcggattctgggtttggcgtagccccctcccctctcaggaatcctgggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggttcagaggacagttttggagaaggagatgcgtagtcttggtgttgacatggacgataaagacgatgcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtttaactaggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagtagttttcattt

SEQ ID NO: 2729 - DNA, 4184 bp, Homo sapiens
ggctttgctcagagcttgtagcggcgccacaatctctgtcctctcaggaacaggaactggcttgacgtccttttcctgccctatccaagcccctgttcttgcagcccttctgaagctcagcctggcaccggccccggcgccccagcccctggccaagcctctgctgtcatttctcctccctcctctcagtctgcagctgcgggacgggccgggctcctcagtttctgctgtgttgtgaccccacgaggcgctcagcacccagggaaggcgcgtgtgtccccgatgctggctcctccctgagccccgacggctctcgaggttctgagcctgtggcctgcacagggaacttcctctccgactgcatttatgcctctgtggatgtgaaggctatttctagaaatctcttcctttgcagaaacacccgaaaccctcctgccaggaagaccagggcctgggaagagggtcgctctccggccattctcccctcaccctcctcaccttcctcacatcctgtgccctgggggaccagcagctgcttccacccagaacaagcgggagcctgtgtcaggaaagcatgtcagagcagagctgccagatgtccgaactgcggctcctcctcctgggaaaatgccgctcgggaaaaagtgccacaggaaatgccattctgggcaaacatgtgttcaagtccaagttcagtgatcagacagtgatcaaaatgtgccagagagagagttgggtcctgagagaaaggaaggttgtggtaattgacacccctgaccttttctcctcaatagcttgtgctgaagacaagcaacgcaacatccaacactgcttggagctctctgctcccagcctccatgctctgctcttggtaattgccatcggccatttcacaagggaggatgaggaaacagccaagggcatccaacaagtgtttggagctgaagccaggaggcacatcattattgtcttcactcggaaggatgatttgggggatgacttgctgcaagatttcattgaaaaaaacaaacctctcaagcagttggttcaagactatgagggccgatactgcattttcaacaacaagaccaatagtaaggatgagcagatcacccaggtgttggagctccttcgcaaggttgagtctttggtgaatacgaacggaggaccctatcatgtgaacttcaaaactgaaggcagcaggtttcaagattgtgtgaatgaagctgcatctcaagagggagacaagccacagggcccaagggaaaggcagctgcagtccacaggacccgagcagaatccggggacatcagaactgacagtcctccttgtggggaaacgcggtgctggaaaaagtgcagcaggaaacagcattctggggaggcaggcctttcagaccggatttagtgagcagtcagtaacccagagcttcttgtctgagagcagaagctggagaaaaaagaaagtttcgatcattgatgctccggacatctcatctttaaagaacattgactcagaagttagaaaacacatctgtacaggcccccatgccttcctgctggtgacaccactgggcttttacactaagaatgatgaggcagtgctgagcaccatccaaaacaattttggagaaaaattctttgagtacatgatcatacttcttaccaggaaagaagatttaggggatcaggatctagatacgttcttaagaaacagcaataaagctctctatggtctcatccagaagtgtaaaaacagatatagtgccttcaactaccgggcaacaggagaagaagagcaaaggcaggcggacgagctcctggaaaaaattgagagcatggtgcatcagaatgggaacaagcattgtgttttcagagaaaaagaaaccctgaacattgtccttgtggggagaagcgggactgggaagagtgcgaccgggaactctatcctggggagcctcgtcttcacctctcggctccgggcccagccagtcaccaagaccagccagagtggcaggaggacatgggacggacaggaggtggtggttgtggacactccttccttcaaccagatgctggatgtcgaaaaggacccatcccggttagaagaggaggtcaagcgctgtttgtcctgctgtgaaaaaggggacacattttttgtcctggtgttccagctgggacgattcactgaagaggacaaaacagctgtggcgaaactggaggccatctttggagcagactttacgaaatacgcgattatgctgttcacccggaaggaagacctaggggcggggaatttggaagacttcatgaagaactcagataacaaagcccttcggcgcatttttaaaaagtgtgggcggcgagtttgtgcttttaacaacaaagaaacaggccaggcccaggaaacccaggtgaaagctcttttaacaaaggtcaatgatctgagaaaagaaagtgggtggtccgggtatccccatacacaggagaacgtcagcaaactaattaaaaatgtccaggaaatgtcccaagccgaaaaactccttaaaaatttaataggtattttacaataggtagccgaagtgcctggggtctcttcaattagagacaccctcaggttggggggaggggcggggcatggtacaacctgtgggaagggaagcgggttcatggctttgagggcctgagaggcaaatgcatcccgccttgtgatgtatcagctatttgtagataaataaattgcaggtgggggcgaatagtagggtattataaaggagaaagaagatacaaggtggggaaatctggaaaaagatttcagacattaggctgataataagtggtagaatcaagtcacaagaatcacctcacttgtgtaggtaggttggaatcaggatagacactgtgatcaaggctgaggccacctgggatgagaatatagatagtcgtacaacaacccaggggatccagatacatgagaccagggcagcgttcagcacactcctgggcatggcggaagcaggaagcagactccagagggcctccctgttgtccagggccgttggctccctgagctctcctgtctcctttgggatgcgacttagggctagagtgttcttttcttcacacgttagccattccttacggctcttcacgttccacgcctagatgtgaagtgggacatagtcttccattgctggctgtccctgaggaaacagacatgagtcttggaggttctgaatgattttattgctaattatcacagtgacatagactagaacagaaattagaagcatagtaagattgccaaaatcagagaatcttgcaaagttctgtaattctaagtgttgttctagatttcctctagagaaggttattagaatctccattgcgtttctctttctccttctctttcccttgaggttaggaaacaggttaaaactcagagaactccaataataatggtttaaaaacatcaggggcttcctgtatctcctgtcaggaagccgaggaataagcaggctggggctggtgggcgtcaacatcccagttttgttctatctttctgtcccacctgcactgggatgtggcttctacactcgaatttgcttcttggtttcaagacagtggtgttctttccatagctgagcagattattttgagaggtgggtgatatgtgagagagaaatctggaaccttcttctgggtagatacaggataagatagatacagggtaaaatgttgagcactttgtacatgctttgagagcataatctttgtcatctgtttttttcccctagacaatatcaggttaccgtcaacattaatccatttaaaaggacatggactgttgccattaatacttttggattccatataacccttaacacaataacttctagaaaatgtgtgtgccgtagacacaaagaagggaacaatagacaccagggtatacttgagggtggagggtggcaggagggtgaagattgaaaagctgcctattgcgtgttatgctggtttcctgggtgacaaaattacctgtacaccacacccctgtgacacacaacttactcatgtaacaaacctgtgcatgtaccccttgaacctgaaataaaaattggaaagtaaaaaaaagtgtgtaaatatatttagttgaatcaaataataaagatgaatcattatgaattc

SEQ ID NO: 2730 - DNA, 964 bp, Homo sapiens
ttctgggaagggagaatggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagaggtgagaggcgattctacggttcacctgcgcgccggcgtcacagcgctaccgcttcctggccgtccggctcgcggtgtgttttataggcagagcaatgttggaaaatcatctctaatcaagctttattttcactggcccctgaggttgaagtcagagtctccaaaaaaccaggacacacaagaaaatgaatttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattc

SEQ ID NO: 2731 - DNA, 1787 bp, Homo sapiens
ttctgggaagggagaatggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagagggacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattcaaaaaaaaaaaaaaaagctttatgctaactggagttaaatacctagaagaatttcaacattgttttaaatgttgtgcatctgtaacttcaggaggatcacttgagctttaaaacctgtgccttctcgaaacaagaatttgtgcctgaggtgaaaaaagtttgtaagttattgaattatggtgttcattagaacagctactagctgattcccctattttaacaaactgacaagagcacatccataaaatgaaaacctgttacaactatgtacagaagggtttgacgttttattgggcttttgtcttttaaagaatatgtctactatgggtattttttttttaaatgttaaaatgggctaggtaaaagggggctgcttttctgttaagcatcgataggtaagttgatggataaaagttactatgtaagcctatttttttgagtccttatttgaatattgaaaacattcttgataaaatgtgttagtccatgttggaaacaaccgaaagaacagaattcaagttctagttctgatgtttattatatatgttggatcttgggcaacttacttgatttctcggaaattcatttgttactgtaaacgtgaaagctattaagattcaaatgaatggttttacagcaggtaacatgtgagaagacagctacatatttgtaaagccaaaccaacaaagaaatatagcaaaattcacaggtagatttattacaagaaatgtcctttcatgggggaagtaacattttcactagtgaaaaagcaaaaaacaaaaatagctttaagtgagaaaactaatttgtaaagggcaagagaaaaaagctgatgggacagtttagactgctacatttaagattcagaatggaaaaataaagcctttgaactaaagttaatagagaagatttttgtgaaggtgccactaacctattcatgtaagtggcttaggttttcaaagtgaagcttaatattaaaaggttatagctg

SEQ ID NO: 2732 - DNA, 1360 bp, Homo sapiens
gcgtcgcggcagcgggaagtcacgcacgcgcaacccaggccacaggagtaaaatctctctgcccgtcttctgggaagggagaatggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagaggtgtgttttataggcagaagcaatgttggaaaatcatctctaatcaaggctttattttcactggcccctgaggttgaagtcagagtctccaaaaaaccaggacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattcaaaaaaaaaaaaaaaagctttatgctaactggagttaaatacctagaagaatttcaacattgttttaaatgttgtgcatctgtaacttcaggaggatcacttgagctttaaaacctgtgccttctcgaaacaagaatttgtgcctgaggtgaaaaaagtttgtaagttattgaattatggtgttcattagaacagctactagctgattcccctattttaacaaactgacaagagcacatccataaaatgaaaacctgttacaactatgtacagaagggtttgacgttttattgggcttttgtcttttaaagaatatgtctactatgggtattttttttttaaatgttaaaatgggctaggtaaaagggggctgcttttctgttaagcatcgataggta

SEQ ID NO: 2733 - DNA, 686 bp, Homo sapiens
tttgcggttgtattttctagctttatgttggcgcatatattattttaactcaataggcatatgtcgatgctccctgtacgtggggatacccgagaaacccattgttaagtacaaaatgcagtcaatacccataaacccatggtgtgttttataggcagaagcaatgttggaaaatcatctctaatcaaggctttattttcactggcccctgaggttgaagtcagagtctccaaaaaaccaggacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattca

SEQ ID NO: 2734 - DNA, 1518 bp, Homo sapiens
aaaaatcgttaagtcgacccactgtaagcagagactgcctgtatacagcttaaattattttggaatgaatatagaagacttcaaaatgctttaaaagcttttcaaacccaaattaagcattcaaaaaattaactctccttttttcttctatttaacttaagtagggaaaacatgccagacaaattagacagaatttagacagtgaagaataggaaacgaataatagtttcacaaatgagatggtccttatcaataagtaactttcgcctaatctaaatttcctatcgtgcaaaaataataatctctagatggcaataatgtggaaaaatttttataacaacgtttattagtgaaatttcatgagtgagcattcttgcatgtcctacaatttattgatattctgttctaagtctgctaaaaggcatctcaactctccatatgtatttacactaagtgcaccattgcccagagatatttcgtctaaatatatgtggaactatagtcaggattcaaagagtacctcaattatttaatgattttgagacagccattgcttttttatttaagcttctaaattactggacttttttgtaattcgtttttaaaattcagttttatctacatattagcattagatttgctctggcagagcatttaaaatttttgcaggactcagatcaattaattttgaagaactgaccagaattttccaggataggatccctggcccctgcccactaaatgtcccccaattgtcttgataaccaaaaatgcccttaaaatctccaaaatgtccctcaaggggcagtacggccgtcatttagaacaactgattggcattgtaccccctcccccaataccatgttcaaaagcagagccatgtgtattaatggttattatcgagaatattctgttgttttccacactacagaggagacaagcttaattggaacaagagaggtcaagggaaaagagtgtgttttataggcagaagcaatgttggaaaatcatctctaatcaaggctttattttcactggcccctgaggttgaagtcagagtctccaaaaaaccaggacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattc

SEQ ID NO: 2735 - DNA, 1635 bp, Homo sapiens
gaagggagaatggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagagggacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattcaaaaaaaaaaaaaaaagctttatgctaactggagttaaatacctagaagaatttcaacattgttttaaatgttgtgcatctgtaacttcaggaggatcacttgagctttaaaacctgtgccttctcgaaacaagaatttgtgcctgaggtgaaaaaagtttatggagtctcactctgtcgcccaggctgcagtgcagtggcgtgatctcggctcactgcaagctccacctcctgggttcacaccattctcctgcctcagccttccaagcagctgggactacaggcacccgccaccacgccaggctaattttttgtatttttagtagagacggggtttcaccgtgtttgccaggatggtctcgatctggaccttgtgatccgcccacctcggcctcccaaagtgctgggattacaggcatgagccaccgcgcctggccgacaacatgatttttaatagtgaaactattaaaacaagatagaaaattattaactactaaatttcaacagtctataaagtaccacagagatgaggaaaacgattggctttaatcactgaacaaatatattctttgattagatgaagcttgttcttatgttcctctgcatcttctctctttctcccttctctctcttgggttttttttctcttttgaaccgcagttcacttactatgttttccaagtgctttaccatctgggtttgtcaatacctccctcaaaggatggtgtccagacttgaaaactgaaaaagataggagctgaccctaaagaatttaaggattgttccctccattattcttgaaaaccgctgttaaaacagaatccataaccttggttcaatttcta

SEQ ID NO: 2736 - DNA, 1016 bp, Homo sapiens
ttttctctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccagtctcattctgtcgcccaggctggagtgcagtagtgcgatctcggctcactgcaagctctgcttcccgggttcacgccattctcctgcctcagcctcccgagtcgctgggactacaggcgcctgccatcaggtctggctaattttttgtatttttagtagagacagggtttcaccatgttagccaagatggtcttgatctcctgacctcatgatccatccaccttggcttcctaaagtgctgggattacaggcgtgagccaccacaccaggccctattattattattatattttttttggagatgaagtttcacttgttcgttgcccaggctggagtgcaatggcacaatcttggctcattgcacccttcgcttcctgggtttaagcagtgttcctgcctgagcctccccagtagctgggattacaggcacccgccgccacacctggttaatttttgtatttttggtagagaca

SEQ ID NO: 2737 - DNA, 1403 bp, Homo sapiens
ataggggcggggaagcagcccggcggtcctcatgggaatgtgccgtacacttcacctctttcgcttctcgctctacatcatccctgagaagcctttttaaacacttgaatgtgcttgtttcagagtgtatttgtaaagtgcagtcagattttgttgtacggaagacgggactgtgatgccttgcaatttccctctgccttttgcattacatggcgccgccatcttgagcagaaatgtatcatggggctcgccattttgcatggtcgagcgggtatttccggttccggcggggggcttttctctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaactggc

SEQ ID NO: 2738 - DNA, 1469 bp, Homo sapiens
gattcctgctcatcctaggggcgccagcttcgctggaggacgccgcgctctgcgggtccccgcctcggttccaggcccagctgcaggtgccacccaggtttcaggcgctgaggagcggagagcactgccagctcgctggggtccccgctgtctctggcaagcggctccgcgccgggtgggctggggcggcggggcgggcgcagctgcttccccgccccggggcggcacccgcgctcggggctggcggctcctccccgcccggccgggcccagcagcccctaggagcccagcgccgccgccatgtcctccggggctagcgcgagcgccctgcagcgcttggtagagcagctcaagttggaggctggcgtggagaggatcaaggtctctcaggcagctgcagagcttcaacagtactgtatgcagaatgcctgcaaggatgccctgctggtgggtgttccagctggaagtaaccccttccgggagcctagatcctgtgctttactctgaagactctaggagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttttgtttatttaaacaactgaatacttataaactgttgttcctggaagttatttattccataaaaaatttgttcttttgtcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttacgtttctctgctttgtagttgtggctgtacttaaagaaatacagaatttcatatatttaaaaatgtttaaaatgtgacccacagaacattgtaaatgattaaaaactaacatgaaaatattacaacctaaaagaattcttaacttcacaagtgttttacttcgacgatgtgcctttgatttaatttgggacacttttttagaaggatacattattcgtgtttgcaacggtctttgaagagcttggaaataaaatttctgcttaatt

SEQ ID NO: 2739 - DNA, 4404 bp, Homo sapiens
agcgaggcggagccggcgcccggaggagcaagaggaggaggaggaggagaggtcggagccgtctccaggagcccttagagaccgagtcccggcggcgacggcggggcagcgcaccggcaggcggattcattccacttaaaacctgaaaacattggaccacacaaagtcttactgatttcaggtaaaaacaataattgaagatgtccagcaaaacagcaagcaccaacaatatagcccaggcaaggagaactgtgcagcagttaagattagaagcctccattgaaagaataaaggtttcgaaggcatcagcggacctcatgtcctactgtgaggaacatgccaggagtgaccctttgctgataggaataccaacttcagaaaaccctttcaaggataaaaaaacttgcatcatcttatagtggaatagagaaacagctcctcgcctcttcccaacaacgcaaattatgagcagctccttgaagagatttaccttcagcttatttggtaaccactgctaataactaaaatgttctcagcttggaataatggactctgaagtctctattttccaagttgtcctttctcttaaaataccctttactgatttaatacagaataacaatcttattttccacttggtaactatggctttatgttgggttactgtttaaggaaagttgatctgggcctttttaaaaacataattatatactttagaaatacaagggattccgatatgtcaggacctaaatggcctaagcacctgtcaaattaaaattccaaaattcattgaaatcctaaagccttgatattatattctttataaggcgtgtgccagcctgtatagtatataagagagaggggtgtttgtgtgtatatatatatgcctttgtgtatacacttatcaaagctattttcttatgaaaacgtccctctctccataccatcagtttctcagttccagaagttatacctttattttgagctgtgtataggtagaataaaaaattcctttcatatcgttattgtacaaaaagtaaagagtatcctaaagattgtattcattgtaatcaagtaatgcaatcatctctcctctcttgaaatcttgctggacctcttaggctacaataaactgtaccaaactaaactgacagtccttcgataatatgaaacattaatttacaaggacccgttagggcttcaatgatgctgagtctggaaaaggggaggagacccttgggaggactccaggcagctgtgctcccagggctcatgttctctactggattagggataggcacctctgaaatctccaccctgatgattggaatgaaacggagtgaacatgagcccagctgagagaggagcaggaatgtgtgaaaaacagctgctctccttgtcccagctttgtgattgagccctctgtcttgctctctctgccttccctgtgtctttcttctcttaccagagcatctgtttgcagaggtaacattaccttccccagccacaggtatgtggaatacggtgaggaaaaaaaaaattaaaaaaaaaatgcaagctgtcaggatgcttaagctcttttcagacatctgcagtttcatccctaccttgttcacataccatccaagaggcacataggctacccaagagagccttggattcagtggtacactccttgggcccaagggctttagcagctggatatggggttccttgattttcctctgggcccaaatatagccctcacactcttggaatttccaggtatgggggtagccccaaaaggaggaatctcctatggccaataaggtatcttgactttatcaaagtagaagagagggtcacttcggagtcaaatcatacactaggcctttgatgctttaattcttcttcagttcattaaaagtaactactaaggaaaggttaaaaacttcccctcaaaaaggaatcaaccccaggaagtaattatttacaacgattttcccaaattttgtacaatctgtcctggaaagcaaaccccttttaaaatctaatgtctgggctttgagtattagctcatttagggtggacaaatgcattactgttttcaaactgctcacatttattcagtatttctccaagttgctatctactcagccttatgaatgcccctcgcttttctaaggccatgtgaaaatcacggcactgcccttagccttgtgtcatctgctttttcgttctgcgatatgcccagttcccaaatcaattataggtacctgtttaggagagaggaagattttacctctcaaagggtgagatttgaaatttacactaaaaagacaactttacatttaatgcttcacttaatgagacattcttttttttataagtctatttttctactcagtttcagaacactaatctgattttcactctgatttttaacgtttctttaaatatttataatgtagcttctttcaaaatattttcatgaaaaattacttttattataccattatgtgcatgttattggtagcaggcatagtttattatttagtactgaaacatgctcttttacctaacagtaaacaagtatgttttgatatatatctgttaatatgcttatagtggtaagaaatggacttgaggtcccaggagatttcattttattcaccctggtcagatacaataaaggctatgagtataaatacataacttcctaaccaggtgtagggcatgttcatgaatatcaaatcttttgatgctggacccaagagaggaaaagttgtagctaaatgttgatttacttataactagacgtctatgtgagaaaatatatgtatacatatatatgatatgcagaagtcactttttttatcaggctttattctccttacaaagccacagtttaactgtctgcaacagttggtttatgttaatgatagacaaatacccagtgtttgttactttttccaactaccactgtaatgataatctttctcacgtatatacatgcaacttcttggcttcatttccatgaagctgtttcaatatattcagtatactttgtccttaatgctgcttctgttaacagtgatctctttctttttttcattcttatatcttcattagttcatcataaatctgtccagttgaggcctcaggaccacggcatgatttcatgactccgaagtattttacagaaacattttttaaataagggaaatattttatataccagatggttcacaagtgatggctcatagctagtttttttttttcttctaaaaaatgtcaggtttttaaaatcatttaccttattaaaatgaaaagtgccatacttaacttttaaaggaaagacctgacttgctttttctctatttagactgtttttgtactttactaatctttaaactatcaggaaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttggttactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttctgtactgcgtcagtgcctcattgtatcatcctacttgtgttttgctcaataaatgaataaaagaccatttctcttc

SEQ ID NO: 2740 - DNA, 882 bp, Homo sapiens
ccaggatctgagcagctccttctagcatccttcatccttcaggtaccagccatccagacagtgcttgagctgcagaaactgagaccagacctctggcctggccctccccaggggcctcctttcgtatagtcactgcttctgcatcagatactttcagctgcaactccctactgggtggggcacccatttcaggcagaaggttttggtaccctccactgaccctacacccagggctgctactgccgcttgtggcttcaggatgaaaggtgagaccccggtgaacagcactatgagtattgggcaagcacgcaagatggtggaacagcttaagattgaagccagcttgtgtcggataaaggtgtccaaggcagcagcagacctgatgacttactgtgatgcccacgcctgtgaggatcccctcatcacccctgtgcccacttcggagaaccccttccgggagaagaagttcttctgtgctctcctctgagctcccctgtcccttctcacaactcctcccttttccctctcctgggcccttccttaggtcagtaattgttgtgagccccttaggctccttgcatcccatccctaacccttgcctgaccatgtgaggttatctgaagcacaaggcccaccctcacctatctgtcgaccccatttcctaccacctttgtggccgaccccaagcaccccagagatatgaggcaccctttgctccacccacagcagggccccgtcagactctgccagcgcgtcctgcccgcttccctcggtgacctgctcagacaatggagagggatgggccaggttcttgctctcagtctcacctggagctactgggagggtaaagccatttgaagaataaagtcatccagagcctca

SEQ ID NO: 2741 - DNA, 1595 bp, Homo sapiens
ctcatctgacgactgacagctgctgccaccgccagcctctgtcccttgcccaggcctgtcacacggctgcctctcagcaggggcagtagaatgaaagagggcatgtctaataacagcaccactagcatctcccaagccaggaaagctgtggagcagctaaagatggaagcctgtatggacagggtcaaggtctcccaggcagctgcggacctcctggcctactgtgaagctcacgtgcgggaagatcctctcatcattccagtgcctgcatcagaaaacccctttcgcgagaagaagttcttttgtaccattctctaactccgtgtgtgatgaaaacgcctccttttctgaccttcaaagtcccctgtagagaccatgcatgctctaagccttagggagtgagaccaacacccatccctgcccagccaacagtggccggggcttgtcttatgtttccatctgttttcttcgtggcattcaatttcatttttttccttttcattttcatgttattttcattattggcaaagaaaatcaaaatgtttatagccaaataacaaatgtgccatgtaaaagtaagtctggacttaagagtttaaaatttttaaacatcagtttccaagtttatatcatattaatacatttcagtggataatttattttaaaaaaaaaactatgcctaaatatcccttatttgcaatattcagtatcaaattagagcattttgaccaactgaaacatataacgttttcatctcctttcctggagaaagcagctgcagaggttctgtatttcctgcatttccatcatcctagtaaaaagacaacaacccacaggattggaatggttttcttttgttttttttttgttgttgttgttgttttgagatggagtctcgctctgtcacccaggctggagtgcaatggcgtgacctcagctcactgcgacctccacctcctgggttcaagcgattctcctgcctcagcctcctgagtagctgggatcataggcacgcgccaccacacccagctaattttttgtatttttagtaaagacggggtttcaccatgttggtcaggctggtctcaaactcctgacctcgtgatccacccgcctcggcctcccaaagcgctgggattacaggcgtgagccaccacacccggccgtggaatggttttcttagcatatcctcctggggccgtggcgccccggctgtgggccgtggtggatgtcccttgtttcagtggtcctacaaaggtagatggtgggcggacaccgaagtcaacttgactgtaaaagtaccccataccgttgacgcgctgtggcagacctgtgggtgcggtctcccctctccaaatgccacctcttcctgctccctcctcttttggctcctactcagtagttccattgtgggctgcagtaatataaggacctgttctggacacagcactgggcccgctggggttttagtagggcagccccttccctgcaggagtgaggcatggtgacagcagtcccctatgtgcccccaagtcatctgagcattggtgtgcattaaggtactcaatcttccaacaataaataccataagtgca

SEQ ID NO: 2742 - DNA, 1721 bp, Homo sapiens
cggtgccacagggacgaggcctggagagcagtcgctcctagaaccggggcgcgaagggcacccccgcctccagcacgcgccctccgccctcccggcctcgctccccccggagtgggggcctcgccggcccctggtccccgtcactcagcaacgtcgggtcagccttcgccgggttagtggcgacgcggccgcgcgaattcgcacaggggcagtagaatgaaagagggcatgtctaataacagcaccactagcatctcccaagccaggaaagctgtggagcagctaaagatggaagcctgtatggacagggtcaaggtctcccaggcagctgcggacctcctggcctactgtgaagctcacgtgcgggaagatcctctcatcattccagtgcctgcatcagaaaacccctttcgcgagaagaagttcttttgtaccattctctaactccgtgtgtgatgaaaacgcctccttttctgaccttcaaagtcccctgtagagaccatgcatgctctaagccttagggagtgagaccaacacccatccctgcccagccaacagtggccggggcttgtcttatgtttccatctgttttcttcgtggcattcaatttcatttttttccttttcattttcatgttattttcattattggcaaagaaaatcaaaatgtttatagccaaataacaaatgtgccatgtaaaagtaagtctggacttaagagtttaaaatttttaaacatcagtttccaagtttatatcatattaatacatttcagtggataatttattttaaaaaaaaaactatgcctaaatatcccttatttgcaatattcagtatcaaattagagcattttgaccaactgaaacatataacgttttcatctcctttcctggagaaagcagctgcagaggttctgtatttcctgcatttccatcatcctagtaaaaagacaacaacccacaggattggaatggttttcttttgttttttttttgttgttgttgttgttttgagatggagtctcgctctgtcacccaggctggagtgcaatggcgtgacctcagctcactgcgacctccacctcctgggttcaagcgattctcctgcctcagcctcctgagtagctgggatcataggcacgcgccaccacacccagctaattttttgtatttttagtaaagacggggtttcaccatgttggtcaggctggtctcaaactcctgacctcgtgatccacccgcctcggcctcccaaagcgctgggattacaggcgtgagccaccacacccggccgtggaatggttttcttagcatatcctcctggggccgtggcgccccggctgtgggccgtggtggatgtcccttgtttcagtggtcctacaaaggtagatggtgggcggacaccgaagtcaacttgactgtaaaagtaccccataccgttgacgcgctgtggcagacctgtgggtgcggtctcccctctccaaatgccacctcttcctgctccctcctcttttggctcctactcagtagttccattgtgggctgcagtaatataaggacctgttctggacacagcactgggcccgctggggttttagtagggcagccccttccctgcaggagtgaggcatggtgacagcagtcccctatgtgcccccaagtcatctgagcattggtgtgcattaaggtactcaatcttccaacaataaataccataagtgca

SEQ ID NO: 2743 - DNA, 5104 bp, Homo sapiens
gggggcgagggtcgcagagtcgccggctctcccttccccagtctgggcccccacggcacagggggccgagcagaagcccccagcgtccagggccgggggagggtccgcctgcgcccccaggcccgcgtggtcgggccctgcagggcgggaggcgcggcgcggggcggggccggtgacgggacgcggagaccccgcgggcggcgggaggggcacgaggcgcgcgtttgcacccgagcccggcccgcgccccgatgcggagcgatgccgctcggcctggccgccccccgcgagcaccgcgctgcagacgaagcccgcgcgtgatcccgctccgggtgacctcaaagcagaagctctgaattcacctctcatctgacgactgacagctgctgccaccgccagcctctgtcccttgcccaggcctgtcacacggctgcctctcagcaggggcagtagaatgaaagagggcatgtctaataacagcaccactagcatctcccaagccaggaaagctgtggagcagctaaagatggaagcctgtatggacagggtcaaggtctcccaggcagctgcggacctcctggcctactgtgaagctcacgtgcgggaagatcctctcatcattccagtgcctgcatcagaaaacccctttcgcgagaagaagttcttttgtaccattctctaactccgtgtgtgatgaaaacgcctccttttctgaccttcaaagtcccctgtagagaccatgcatgctctaagccttagggagtgagaccaacacccatccctgcccagccaacagtggccggggcttgtcttatgtttccatctgttttcttcgtggcattcaatttcatttttttccttttcattttcatgttattttcattattggcaaagaaaatcaaaatgtttatagccaaataacaaatgtgccatgtaaaagtaagtctggacttaagagtttaaaatttttaaacatcagtttccaagtttatatcatattaatacatttcagtggataatttattttaaaaaaaaaactatgcctaaatatcccttatttgcaatattcagtatcaaattagagcattttgaccaactgaaacatataacgttttcatctcctttcctggagaaagcagctgcagaggttctgtatttcctgcatttccatcatcctagtaaaaagacaacaacccacaggattggaatggttttcttttgttttttttttgttgttgttgttgttttgagatggagtctcgctctgtcacccaggctggagtgcaatggcgtgacctcagctcactgcgacctccacctcctgggttcaagcgattctcctgcctcagcctcctgagtagctgggatcataggcacgcgccaccacacccagctaattttttgtatttttagtaaagacggggtttcaccatgttggtcaggctggtctcaaactcctgacctcgtgatccacccgcctcggcctcccaaagcgctgggattacaggcgtgagccaccacacccggccgtggaatggttttcttagcatatcctcctggggccgtggcgccccggctgtgggccgtggtggatgtcccttgtttcagtggtcctacaaaggtagatggtgggcggacaccgaagtcaacttgactgtaaaagtaccccataccgttgacgcgctgtggcagacctgtgggtgcggtctcccctctccaaatgccacctcttcctgctccctcctcttttggctcctactcagtagttccattgtgggctgcagtaatataaggacctgttctggacacagcactgggcccgctggggttttagtagggcagccccttccctgcaggagtgaggcatggtgacagcagtcccctatgtgcccccaagtcatctgagcattggtgtgcattaaggtactcaatcttccaacaataaataccataagtgcatgtctgttttattttatttatttatctttttgagacagagtcttgctctgtcgcccgggctggaatgcaatggcacaatctcagctcaccgcaacctccactcgcaggttcaagtgatcctcatgtctcagcctccctagtagctgggatgacaagcacacgccaacatgcctggctcatttttgtatttttagtagagacggggtttcaccatgtcggccaggctggtctccaactactggcctcgagtgatctgcccaccttggcctcccaaagtgctgggattgcaggtgtgagccagtgcacccggccgtatgtcttagagtgaggggaaactgaggcacaaagcgtttatgtagtttgcccaaggttacacatggtaagcagaaaaactgggatttgagggcaggcagcccggccccagagttcccttagccccctgaactgtgctaccttccaggtctacctgtttgcaggtagggagacccacaaactatcataactgcacaccgtgaagcaaacacctttgttgcagtaacccgtggcacacttcacttcccacattctccaggaggaagccgtattctggtagtttaaggaaggtgattcatggatgccccaaggaaaggctagacatcgatgaattagctcttggattgtctaagatcaacctgaaggtcctacctaaaccaaactcatatgatcccgatgaaagaggagaatacacagtgggagcagagctctttgtgtaagtttgttctattctgtttatttggaaactgcctctctccctagttctgaaagagacttgctgtgtgatagagaacaggccatttgtgcctgaaatgttctaacctgcaaattgggtttaatggtaattatcctgcctttctgtctgggaggaaacagagatgctacatagatgaaagctctgattatcatttaaaacaaataaatgtactaaatgccgtggtataatatagggaagaatggatgacttcaaagagaccatggttccgttggaggcataaaattgcctgcaaagaggcaaatgtaatttccagaccaattaatgacttgctgccctcgtaaatggatttaggacatctttgttccttgcttcttttgttaaaactcattcttagtttcattatcagctcactaataataccagtgttgttaagatgctcaaactagagcagaattgtatgctggatgtgacgctaggacctcagatcctttgatagtgcagttatgaccaggatctctttattctgtgcttcacgtcaacatcattaacccgatgaagcgaagcacaagtcataaaggcacatcagagaagccgagaaagcggggccgtacagagagcatcaaaatcaggtcagaaaaatgctgctttcctcttccaccaaaccttctccctgttgtttttacatgccccgtccctccagattcagcctccgttttgttctctctccttttccttttcctcctctcttccttaccttcccctgtgagatgcttttctgtccttttactgcacctcttccagacctatggcatttggggacgggtcacccttcctagagtgatcctgaatccagctgcctcttctttttttgtttttgtttttgtttttgagacagagtctctttctgtcgtccaggctggagtgcagtagcgcaatcttggctcactgcaacctctgcctcctgggttcaagcgattcttgtgcctcaacctcacgaggagctgggattgcaggcgcccgccaccacacccggctaatttttgtatttttagtagagacggagtttcaccatgttggccacgctggtcttgaagcccagacctcaagtgatccgcccgccttggcctcccaaagtgctgggattacaggcatgagccaccgcgcctggcctagttccctcttcttagatggagatttctgcacatgagctgtgagatccacagacatgtcactgagctcccccactctgtcagtggaagatgaatggaataaagcctgcttgcattgtggagtgcagctgtggggacagttgtcatttttgtgttttcagcttaactgtccagcatctcccctcccttcctacagcagggacatcatgccttagatataaacttagtggtgtgcagtacccaccgtggaagctgaagaagggaagtatttcctgtctctcaggcacaccccgcttccagccccataccagtcgggaagtggtcattgacctggggtggactacctggacccttgcttggggctatgagcctggagaatgtgacacaaatgaagggatgctgagactcatttcaaggaagccaccgtggtccggggttggtagtcatacagcaaggcaggtgggtagggctggcaggctgcagggatggtgtgtccactggtagcaatgtccagggatggcagcgtcctgggaatgtcatttctgctccactccttggactcgctgagctgtctccgcctccacctatcttcctacagacctcccttctagttttctgtcaattctttgagccagcaaactccatccagtacattctttcttctttcatgaaagagcttgagttggatgtaaatatatatgacctaacaattccacccctaggtgtataccctacagaaatgtgtacatgtgttcatccagagacatgctctaaatcttcacaaaaacactctccataataaccccgaacaggaaagcaccccaatgcccatgttggctggataagcacattagggtatattcacacgatggaatcccagactgcaatgggaatgagctgcaactccacccccaacttggagtgtattcaccaaccctagtgttgaacgagataaggcaaaaatgcaccataggattccatttatataaagtttaaaacccagcaaaattcatccatgcggttgcaagtagagatcagtcctaagaagacagtaaccagaagcgggcatgaggtggtgcttctggggtgttctgtttcttgatctggttgccggttacctgggtgctttccgtttgtgaacattcttggagctgtacacttttgatctgggcacttttctgtgtgtatgttatacttcaataaaaagttgggctttgtgactagc

SEQ ID NO: 2744 - DNA, 4978 bp, Homo sapiens
cggtgccacagggacgaggcctggagagcagtcgctcctagaaccggggcgcgaagggcacccccgcctccagcacgcgccctccgccctcccggcctcgctccccccggagtgggggcctcgccggcccctggtccccgtcactcagcaacgtcgggtcagccttcgccgggttagtggcgacgcggccgcgcgaattcgcacaggtgacctcaaagcagaagctctgaattcacctctcatctgacgactgacagctgctgccaccgccagcctctgtcccttgcccaggcctgtcacacggctgcctctcagcaggggcagtagaatgaaagagggcatgtctaataacagcaccactagcatctcccaagccaggaaagctgtggagcagctaaagatggaagcctgtatggacagggtcaaggtctcccaggcagctgcggacctcctggcctactgtgaagctcacgtgcgggaagatcctctcatcattccagtgcctgcatcagaaaacccctttcgcgagaagaagttcttttgtaccattctctaactccgtgtgtgatgaaaacgcctccttttctgaccttcaaagtcccctgtagagaccatgcatgctctaagccttagggagtgagaccaacacccatccctgcccagccaacagtggccggggcttgtcttatgtttccatctgttttcttcgtggcattcaatttcatttttttccttttcattttcatgttattttcattattggcaaagaaaatcaaaatgtttatagccaaataacaaatgtgccatgtaaaagtaagtctggacttaagagtttaaaatttttaaacatcagtttccaagtttatatcatattaatacatttcagtggataatttattttaaaaaaaaaactatgcctaaatatcccttatttgcaatattcagtatcaaattagagcattttgaccaactgaaacatataacgttttcatctcctttcctggagaaagcagctgcagaggttctgtatttcctgcatttccatcatcctagtaaaaagacaacaacccacaggattggaatggttttcttttgttttttttttgttgttgttgttgttttgagatggagtctcgctctgtcacccaggctggagtgcaatggcgtgacctcagctcactgcgacctccacctcctgggttcaagcgattctcctgcctcagcctcctgagtagctgggatcataggcacgcgccaccacacccagctaattttttgtatttttagtaaagacggggtttcaccatgttggtcaggctggtctcaaactcctgacctcgtgatccacccgcctcggcctcccaaagcgctgggattacaggcgtgagccaccacacccggccgtggaatggttttcttagcatatcctcctggggccgtggcgccccggctgtgggccgtggtggatgtcccttgtttcagtggtcctacaaaggtagatggtgggcggacaccgaagtcaacttgactgtaaaagtaccccataccgttgacgcgctgtggcagacctgtgggtgcggtctcccctctccaaatgccacctcttcctgctccctcctcttttggctcctactcagtagttccattgtgggctgcagtaatataaggacctgttctggacacagcactgggcccgctggggttttagtagggcagccccttccctgcaggagtgaggcatggtgacagcagtcccctatgtgcccccaagtcatctgagcattggtgtgcattaaggtactcaatcttccaacaataaataccataagtgcatgtctgttttattttatttatttatctttttgagacagagtcttgctctgtcgcccgggctggaatgcaatggcacaatctcagctcaccgcaacctccactcgcaggttcaagtgatcctcatgtctcagcctccctagtagctgggatgacaagcacacgccaacatgcctggctcatttttgtatttttagtagagacggggtttcaccatgtcggccaggctggtctccaactactggcctcgagtgatctgcccaccttggcctcccaaagtgctgggattgcaggtgtgagccagtgcacccggccgtatgtcttagagtgaggggaaactgaggcacaaagcgtttatgtagtttgcccaaggttacacatggtaagcagaaaaactgggatttgagggcaggcagcccggccccagagttcccttagccccctgaactgtgctaccttccaggtctacctgtttgcaggtagggagacccacaaactatcataactgcacaccgtgaagcaaacacctttgttgcagtaacccgtggcacacttcacttcccacattctccaggaggaagccgtattctggtagtttaaggaaggtgattcatggatgccccaaggaaaggctagacatcgatgaattagctcttggattgtctaagatcaacctgaaggtcctacctaaaccaaactcatatgatcccgatgaaagaggagaatacacagtgggagcagagctctttgtgtaagtttgttctattctgtttatttggaaactgcctctctccctagttctgaaagagacttgctgtgtgatagagaacaggccatttgtgcctgaaatgttctaacctgcaaattgggtttaatggtaattatcctgcctttctgtctgggaggaaacagagatgctacatagatgaaagctctgattatcatttaaaacaaataaatgtactaaatgccgtggtataatatagggaagaatggatgacttcaaagagaccatggttccgttggaggcataaaattgcctgcaaagaggcaaatgtaatttccagaccaattaatgacttgctgccctcgtaaatggatttaggacatctttgttccttgcttcttttgttaaaactcattcttagtttcattatcagctcactaataataccagtgttgttaagatgctcaaactagagcagaattgtatgctggatgtgacgctaggacctcagatcctttgatagtgcagttatgaccaggatctctttattctgtgcttcacgtcaacatcattaacccgatgaagcgaagcacaagtcataaaggcacatcagagaagccgagaaagcggggccgtacagagagcatcaaaatcaggtcagaaaaatgctgctttcctcttccaccaaaccttctccctgttgtttttacatgccccgtccctccagattcagcctccgttttgttctctctccttttccttttcctcctctcttccttaccttcccctgtgagatgcttttctgtccttttactgcacctcttccagacctatggcatttggggacgggtcacccttcctagagtgatcctgaatccagctgcctcttctttttttgtttttgtttttgtttttgagacagagtctctttctgtcgtccaggctggagtgcagtagcgcaatcttggctcactgcaacctctgcctcctgggttcaagcgattcttgtgcctcaacctcacgaggagctgggattgcaggcgcccgccaccacacccggctaatttttgtatttttagtagagacggagtttcaccatgttggccacgctggtcttgaagcccagacctcaagtgatccgcccgccttggcctcccaaagtgctgggattacaggcatgagccaccgcgcctggcctagttccctcttcttagatggagatttctgcacatgagctgtgagatccacagacatgtcactgagctcccccactctgtcagtggaagatgaatggaataaagcctgcttgcattgtggagtgcagctgtggggacagttgtcatttttgtgttttcagcttaactgtccagcatctcccctcccttcctacagcagggacatcatgccttagatataaacttagtggtgtgcagtacccaccgtggaagctgaagaagggaagtatttcctgtctctcaggcacaccccgcttccagccccataccagtcgggaagtggtcattgacctggggtggactacctggacccttgcttggggctatgagcctggagaatgtgacacaaatgaagggatgctgagactcatttcaaggaagccaccgtggtccggggttggtagtcatacagcaaggcaggtgggtagggctggcaggctgcagggatggtgtgtccactggtagcaatgtccagggatggcagcgtcctgggaatgtcatttctgctccactccttggactcgctgagctgtctccgcctccacctatcttcctacagacctcccttctagttttctgtcaattctttgagccagcaaactccatccagtacattctttcttctttcatgaaagagcttgagttggatgtaaatatatatgacctaacaattccacccctaggtgtataccctacagaaatgtgtacatgtgttcatccagagacatgctctaaatcttcacaaaaacactctccataataaccccgaacaggaaagcaccccaatgcccatgttggctggataagcacattagggtatattcacacgatggaatcccagactgcaatgggaatgagctgcaactccacccccaacttggagtgtattcaccaaccctagtgttgaacgagataaggcaaaaatgcaccataggattccatttatataaagtttaaaacccagcaaaattcatccatgcggttgcaagtagagatcagtcctaagaagacagtaaccagaagcgggcatgaggtggtgcttctggggtgttctgtttcttgatctggttgccggttacctgggtgctttccgtttgtgaacattcttggagctgtacacttttgatctgggcacttttctgtgtgtatgttatacttcaataaaaagttgggctttgtgactagc

SEQ ID NO: 2745 - DNA, 4246 bp, Homo sapiens
gagtgtcggccccgcccccgcagaggggagcgagcgctcgcgggccggggcggagggttcggctgcgcggcggggctgaggcggccgcggggcccgagcgcagggagtggagcttggtttcgggatctcggtgctgcagacggcgagacctcctgcacagggtgtacagcaagctgtgattcctgggaaaactaaaaaagctctctgaacaacggggcccagagctgatggcagacaatgtcagccactaacaacatagcccaggcccggaagctggtggaacagctacgcatagaagccgggattgagcgcatcaaggtctccaaagcggcgtctgacctcatgagctactgtgagcaacatgcccggaacgaccccctgctggtcggagtccctgcctcggagaacccctttaaggacaagaaaccttgtattattttataactgtgttctcatatgttctctctctctctctctctttctctctctctctctctgtctctgtctctgtctcaggcagggcatcattcagtaattagctcaaacaaaacatctcaagtccccaaaacctttaattccaaaagaaatcccccctctccccgccaaaaaaggcgttcccaccgcccggatggggtagaatggaccttgtaggtggagatgaattttcaggtccgaccccatggccctctcagtttgggccaaaagggatggaggctttacggccacttcccgttcggaataactgaaatcccccagcgatggggtaacaattttttaaaactctcgattgccgtttcaattgtggaccggcgccgagggggaaagggaggtgacttcgcccggtggcaatagttccgggagaattggccattggtaaaaagacttcatagggtcactggaatgctttgtgttgtttttaagtagaggtaaaattgagatggggggcgggaggtgacatcatgaagttttttggaaatatctctttatttaaaaaattgttactccatacggctaaactcggattgtgatggttgaacccgtcgctaaactgcacgatcctgcaatgaatgcacgatggagtgtgggggtctggagggggcttcgtctatgaaaagttgccaagtgtgactcccctgcatgatgttagccatgggtcctttctgcagggtcccctctgtgccagaaatgggttttcgggacttgccccagggaagccgtcaccggcccggcccatcatgtttttggattttttttttttttctttttttgagatggagtttcattcttgttacccaggctggagtgcagctgcatgatttcagctcaccgcaacctctgcctccccggttcaagcgattctcctgcctcagcctcccgagtagctgagactacaggcgtgtgccactacgcccggctaattgttgtatttttagtagagacggggtttcaccgtattggccaggccgctctcaaactcctgacctcgggatccgcccacctcggcctcccaaagtgctgggattacaggcatgagccaccgcgcccagtgtgttttaagcatgaggcatccgcgtggctgggagaggctttgaccatccttggctcttccaggttgtcctaccctctggcatccaccatagacgtttttcaaacagaaaatgcaggctggggagccgcggcagggcgggtggggctaccctgtgctgctgtgtgtacaaaattgttccatgatcttggagtgactctgaaggactctgggaggtgagacgttgtcccggagatcaaaacgtccgctcaaaacgttaccctgtcgctcgaacccgatctttttgcttttccacccccgtgcaacccaggacggctgtctgaggccgggagatgccttagacgcaggatgggccactcctcccagcggcaagtggaaatcgaagatgtcatggggtcggggggaggcttctgaaagatgactgcgtcctcctctgcggcacggacgggagcaggtgcagccacatcttccagggcctgccggcatcacctgcggccacacctgagatggaccccacgcagccctgatcgcaggaggcctggccgccccgaccccctccacggggctggcctagaagcaagtagtagaataaaactagcctagtcctgtccctccggccccagtggagacaggcgtctaagaacccgtgccgagagggttcctggacggccgcccaggtcctccgtgcaggcccgtgaggcggggatccctgcttggctcacttcctgagctggtgactgccagggttcccacctcgccaaggctagagggctccgggtgtgtgtgcaggtgtcgggggagtgacctccactcctcaacctcgggcagctcccacaggccacagccgggctccccacccccggcacccagctctctacggcaggtccgggagggctggggcttcggggagccctacccgccaaacctgctgttggcccgggagagccccagaggctcccggagactgcagcctcctgtggttgggctgggagccggcagggtttggggtgtgggcgtccccaccacgcatagcaggaatggcaggaagggacaaaagcctgttccagagaccctgggaggaccccaggcagggagagcccgcctgcctccaccctttccaacaagccatcttggtaactgggaacaaacacaccccaccccgtttttccttaaaagaggccttaatccccgagcccccgctgccagggcagagggaggagggggcacagctgtgccaagcccggccccactggtgtgtcctcacaatgtgaccccagaaatgccagcagggaacggaggctgctgcagagacgcagccccaggcagccggggctcctaggctggtgcagatggtggggttaaacgggctgagcgttccaggtaaactgaggctcggggaggggaaggacaggctggcctctccttcactgtccacagggccttgggttccctgagctgtccagaccccaccatctcccggaccccagggaggtggccattgccagaagcctgtgggtttctttctagcttgggggattaaaaaaaaaattctccacttttttttttcttgagtagacttcagtgaccacactgtggaaaatacctttgcagacgtggcacccgagtgcacacaccgaccgccacatgtgcttttctgccgggaatccctggggtgaacgcatgttttatgggcgtttccaggagcgcgcgtgcacctccagacggggagctggcgggcgggggtggcagcagcagctctagccttggggggacaagcctctctcagctacgccaggggaaaagagagttaaggacactcacccccacccacgcacacacacaaggcagcgtcgggtgggagagagaaggccgtttctccttctgtagcctgggtctcccacgggccttccccgctgctgagcgagacaccagtagccaggtgaagggccacagcgggccaggccccgaccctgttgtgacccacctgggcaccttcccggaccagctccgcctcccctgccctcctctctccaggaaggagccagaaccctcacccctctcccaccctccccaggggtaaccccaggccaagcacagatagctcagctgcgacctctggcctctggggacataaacggggcggctgggccagggcggaaggtgctcctgtttccctccttctgcgtggtccctttgacgggccggccaccgtgtccgaggcgcaacgctaggcctccaggccacgcatccatctccaagttaacagcccgtcctgcccaagttctggggcaggtaggagagggccgtcacacacctgtccgcccgtgagtgacccgggggggcttccgggtggaggtggagccaccacgcccttcctcaaggggtcacttattaaaaagtccacggcctgaggccaggccctctgcacagaagccatatgccggccagccgcgcctcctcctctgtccacggaaccgctgcccatctaaccttcgtaaagacctgtctcctgtttccagccgccgcctgtggttctagcaggttctatgccatctgcattgggatgtctggttgtttttatttctgacttttttaaaattccaggtgtgccgcacccactttctcgcagtgttttaatattgtgtggagttgtcgataccacgtgaattcatacacaataaaaagcctcactctcccttt

SEQ ID NO: 2746 - DNA, 731 bp, Homo sapiens
gaaattggttatcgtgggatatttaaaataaaacaaagaacagtttactttcaggcaaaaagatgccagtaatcaatattgaggacctgacagaaaaggacaaattgaagatggaagttgaccagctcaagaaagaagtgacactggaaagaatgctaatcccagccaggcaccttcaaaaccaatcccttatggactactgaattaaggacagcaagttacacctctgttcctgtcatctgggtgaagccaaaagtagtgacttttagagagagagtgtgggaccactgaggaagagggaaaaaagtgaatctaaattaatgcatatttcaaaagttatgtgaatctgcaagtatcatcctttgaaggaagaaactaacctgacaaatgcttcctggctccagttgaaaataatttgttttactatgtaattaatgagtctgcctagttataaaataatcttaagtcttatatcaaatgttccttggaatttacataaaagcggactaaagatttcatttgaaaaaaaaaaaaacagtaaattggttaaatgacttatggaatggccacttaatagactgacaaaaataaagtagcttagtgttactgtcatgaaagatacactaactgaaaacaaacaagttgaagctaaaagagtttgaataatttgatttcgtgtgtatgtatatatatgtatatttatatatgtatagaacatcacctctctctac

SEQ ID NO: 2747 - DNA, 628 bp, Homo sapiens
atgaaattggttatcgtgggatatttaaaataaaacaaagaacagtttactttgtaagttaagagctgagggaattgttggctaagactgacttgaaataactccagcaattcatgcatagctgctaaccttctacatcttcagcaggcaaaaagatgccagtaatcaatattgaggacctgacagaaaaggacaaattgaagatggaagttgaccagctcaagaaagaagtgacactggaaagaatgctaatcccagccaggcaccttcaaaaccaatcccttatggactactgaattaaggacagcaagttacacctctgttcctgtcatctgggtgaagccaaaagtagtgacttttagagagagagtgtgggaccactgaggaagagggaaaaaagtgaatctaaattaatgcatatttcaaaagttatgtgaatctgcaagtatcatcctttgaaggaagaaactaacctgacaaatgcttcctggctccagttgaaaataatttgttttactatgtaattaatgagtctgcctagttataaaataatcttaagtcttatatcaaatgttccttggaatttacataaaagcggactaaagatttcatttgaaaaaaaaaaaaa

SEQ ID NO: 2748 - DNA, 1943 bp, Homo sapiens
gagtgaggcaatgcctcaccctgcttcggctcgcgcacggtgcgcgcacccactgacctgcgcccactgtctggcactccctagtgagatgaacccggtacctcagatggaaatgcagaaatcaccgtcttctgcgtcgctcgcgctgggagctgtagaccggagctgttcctattcggccatcttggctcctccacaattatgatcctcttctgaaatcaggaatacgaccccaagaaatgacaggcaaaaagatgccagtaatcaatattgaggacctgacagaaaaggacaaattgaagatggaagttgaccagctcaagaaagaagtgacactggaaagaatgctaatcccagccaggcaccttcaaaaccaatcccttatggactactgaattaaggacagcaagttacacctctgttcctgtcatctgggtgaagccaaaagtagtgacttttagagagagagtgtgggaccactgaggaagagggaaaaaagtgaatctaaattaatgcatatttcaaaagttatgtgaatctgcaagtatcatcctttgaaggaagaaactaacctgacaaatgcttcctggctccagttgaaaataatttgttttactatgtaattaatgagtctgcctagttataaaataatcttaagtcttatatcaaatgttccttggaatttacataaaagcggactaaagatttcatttgaaaaaaaaaaaaacagtaaattggttaaatgacttatggaatggccacttaatagactgacaaaaataaagtagcttagtgttactgtcatgaaagatacactaactgaaaacaaacaagttgaagctaaaagagtttgaataatttgatttcgtgtgtatgtatatatatgtatatttatatatgtatagaacatcacctctctctacaaggaatgttaagtggtaccttaacaggctatagctgaagccattaaaatattaaggcctgattttttactaaatcattaaacaataatggtgcagataagtgaagagcaagctcaaaaacaacatgaataattcagtccagcaaattattcactgagcactaaagaacacagcctctgttctagatggctgggatacactgaacaaatcagccaaaggtccctgaccccttgaagctcacctagtgcaccaccatgctcaatcattgtagatgagtgtaaagaaaaattacatgtgtatacttctgagaatttagggatggtgataagccaggaatttaataattattcattctcctccacctttactagtcacatttttgggatgaggaaaaagatttaatcaatatgaactctggtgacacccttgacttctgttgccagctgtgttgtgaaccctgggtcttgtctcctttgatgttggaggcagtgtctgctgggaatctttagctggagtgtggccagctgtttttcctttgtctggagatatatccagaaggagtgggaagggtgcaactttcttctttcctacaaagtaaatatgcattggtgtaaagtagagagaatcaaactgaaattatacaacctgaaaatttattgtaataaataaattcctggcatctggagtattctgttttaaaccaaatgagtcatccctttttccttccccttaaggtttccaaatgttgtgaagaagtaagagattacgttgaagaacgatctggcgaggatccactggtaaagggcatcccagaggacaaaaatcccttcaaggagctcaaaggaggctgtgtgatttcataatacaaacaaaaagaaaaaaaattaaacaaattcttggaaatatctcaaatgttaataacaatatgaatttttctcatgcatactattactactaagcatgtacgtgaatttttaaatttatagatgtaaacttttaataaaaattggggtgtggtaa

SEQ ID NO: 2749 - DNA, 1159 bp, Homo sapiens
gagcattactcttgcctcctatgtccaaaccacagctgtgctcaacatttgaaaaatctgaacatataaactgacaagtatctaccaccacaagatgggaagtggaattagttcagagagcaaggagtcagccaaaagatcaaaagaactggagaaaaagcttcaggaggatgctgagcgagatgcaagaaccgtaaagctgctactattaggagcaggagaatctgggaaaagtactattgttaaacaaatgaagatcatccataagaatggttacagtgagcaagaatgcatggagttcaaagcagtaatttacagtaatacattgcaatccatcctagctattgtgaaagccatgactacccttggaattgattatgtaaatcccagaagtgcagaggaccaacgacaactttatgcaatggcaaataccctggaagatggtggcatgacacctcaactggctgaggtaataaaacggctgtggagagatccaggaattcaggcctgctttgaaagggcatctgaatatcagctcaatgactcagcagcttactaccttaatgatttagatagaataacagcatctgggtatgtgccaaatgaacaagatgttctccattctcgagtgaaaacgactggaatcattgaaactcaattctcctttaaagacttgcacttcaggatgtttgatgtaggtggacagagatctgagagaaagaagtggattcactgctttgaaggagttacatgcattatattttgtgctgcacttagtgcctatgacatggtcctcgtggaagacgaagaagtgaatagaatgcatgaaagccttcacctgttcaacagtatctgtaatcacaagtatttttcaacaacctccattgtcctgttcctcaacaaaaaagatatctttcaagaaaaggtaaccaaggtgcatcttagtatctgctttccagaatacactgggccaaatacatttgaagatgcaggaaactacatcaagaaccagtttctagacctgaatttaaaaaaagaagataaggaaatttattcccacatgacctgtgctactgacacccaaaatgtcaagtttgtgtttgacgcagttacagatataataatcaaagagaatctaaaagactgtgggcttttctaa

SEQ ID NO: 2750 - DNA, 2357 bp, Homo sapiens
gatccggaagtcggagcctagctgcgcgagagtttctgctcgctcaaccgagttgtcgtgttgccctcgcttctcagatccccgccggaagtgaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctaggtgctgtggctcacgtctgtaatcccagcactttgggaggccgaggtgggcagatcacctgaggtcaggagttcgagaccagcctggccaacatggtgaaaccccgtctctactaaaaatacaaaaaaatttagccgtgcttagtggcacctataatcccagctacttgggaggctgaggcaggagaatcgcctgaacctgggagactaaggcaggagaatcgcctgaacctgggaggcagaggttgcagtgagcccagacggcaccattgcactctagcctgggcaacaacacgaaactccgtccc

SEQ ID NO: 2751 - DNA, 2135 bp, Homo sapiens
gtttctgctcgctcaaccgagttgtcgtgttgccctcgcttctcagatccccgccggaagtgtaagtaagaaacttctctcctcttttctcacaatgtgcgctcacctagacggccgggcagttaggatcgtctattggatgtgaaaccagagatgcccgccaacctggaatagagaggaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggcta

SEQ ID NO: 2752 - DNA, 4449 bp, Homo sapiens
caagctgcgccgccgcttcgggttgcttccggatctggtacttgggcagagctccccggggttcattgtcttcgcttcacaggatctgtttgagtcctgtccaccggatcctacggggggtaccttcgaaaaaaaacgggctatgctgctgttgcgtgtgggtaccctctcctgacgcctccgccgcccgggtcatgtggaccctcgtgggtcggggctgggggtgcgcacgcgctctcgcgccacgagccactggggccgcgcttctggtggccccggggccccggtccgcgccgacccttggggctgctccagagtcctgggctaccgacaggctctacagctccgcagaattcaaggaaaaacttgacatgtctaggtttcctgttgaaaatattagaaatttcagtattgttgcacacgtggatcatggcaaaagtactttagctgacaggctcctagaacttacagggacaattgataaaacaaagaataataagcaggttcttgataaattgcaagtggaacgagaaagaggaatcactgttaaagcacagacagcatctctcttttacaattgtgaaggaaagcagtaccttttaaatctcattgatacaccgggccatgttgattttagttatgaagtatccaggtcactttctgcttgccagggtgttttacttgtggttgatgcaaatgagggaattcaagcccaaactgtagcaaacttctttcttgccttcgaagcacagctatcggtaattccagttataaataagatagatctgaagaatgctgatcctgaaagggttgaaaaccaaattgagaaagtgtttgatattccaagtgatgaatgtattaagatttctgctaaacttggaacaaatgttgagagtgttcttcaggcaattattgaaagaatcccccctcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattatatgcaggacaggtgggctatctgattgctgggatgaaagatgtcactgaagcgcaaataggagatacattatgtttacataagcaaccagtggagcccttgcctgggtttaaatcagcgaaaccaatggtatttgcaggaatgtatcctctagaccaatctgaatataacaatctgaagagtgctatagaaaaactgactttaaatgattccagtgtgaccgttcatcgggatagtagccttgctctgggtgctggctggaggctaggatttcttggacttttgcacatggaagttttcaaccagcgactggagcaagaatataatgcttctgttattttaacaacccctactgttccatataaagctgtactgtcatcatcaaaattgataaaggaacatagagaaaaagaaattacaattatcaatcctgcacaattccccgataaatcaaaagtaacagaatatttggagccagttgttttgggcactattatcacaccagatgaatacactggaaaaataatgatgctttgcgaggctcgaagagcagttcagaagaatatgatatttattgatcaaaatagagttatgcttaaatatctctttcctttgaatgaaattgtggtagatttttatgactctttgaaatccctatcttctggatatgctagttttgattacgaagatgcaggctaccagactgcagaacttgtaaaaatggatattctactgaatggaaatactgtagaggagctagtaactgttgtacacaaagacaaagctcattcaattggcaaagccatatgtgaacggctgaaggattctcttcctaggcaactgtttgagatagcaattcaagctgctattggaagtaaaatcattgcaagagaaactgtgaaagcctataggaaaaacgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttactttcagggtattcaggttcaaataacctactagtctttcgttgaaagggagtagttagtgggtaggcaagagcttagattttgaagccatgttgcctgttctcaaatatctgttccaaccactcactagtaaggtgaccgtggccagattaacctttgtttcctcttcagtaaaatcgagattatactactacctacataagttgttgttgtgaagattaaatgaggtaatacgttaaatattcagaggtgcaagacacatagtaagcactcaattgtaactacagttaagtccttaaatgccatcgaaaggttcttagaaactgactttaagcaaaatgacacgtagcacaatgttcttgaatgatgtcatttccttaagtggtttgtaacatcgatgaggaaaaaaaattggtttatgcgtcatttcattttatttttatttattttttgagacagagtcttgccctgtcgcccaggctggagtgcaatggcacaatctcgactcactgcaacctctgcctcctgggttcaagagattctcctgcctcagcctccattacaggcgtgcaccaccatgctcggctaattttttgtatctttagtagagtcggggtttcaccatgttggccaggctggtcttgaactcctgacctcgtgatccacccaccgtggcctcccaaagtgctgattacaggtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactgacttgagagctgtctcagatattttgagcttacagttattgtgaaatcattttaattataaattaagtggagatttacttaaaatcatgtgtagaagtagcctgtgatatagtcctagatacatacattatcatcttatgtatcttccctccctcttccaggttctgataaaaacagatgaaatctgaaagaccatgacagtagtattttgaaaatgacagtatttgaaattaaaaaattgtaaaag

SEQ ID NO: 2753 - DNA, 1834 bp, Homo sapiens
ctgaggcaggagaatcgcttgaacctgggaggcggaggttgcagtgagccgagatcgcgccattgcacttcagcctgggcaacaagaacgaaactccgcctcaaaaaaaaaaaaaaaaaaaaaaaaaagccgtgggtcaggagccagagccctctgctctagtcttagctgtgccaatgtgactccctgtgtgatttgggggtaaattactgcccctcactgggtctctgtctacccacctgcaaaatgagaggatctttggatgagtctccttaattcatttcctggacaaacttcctccaaggctcccccagatttaccagtgacgcccttccctaagtatcaacttagccgtactttgaactctggcccctcaggtttcaaggggacggccttgtctgggatcagctctgtctggggaaagaagctgcaccagcctctggatagcaggctgagtcacttgtttcttgtgccttgagtcagttctctcatcagctctcctcctaggccagtgttattacctccagtaaagatggaaaagttggggttcagagagggctagagacagacagcctgctgtgtcctgtcttttctcctgtgctgtacaggttcaccaatttttaaaatccaaatatatctcatggtacagtggaagaactggccagagagtctggaagtttgggttctggtcctggctgtgccactgactcactgtgaccttgggatcttgtgctgtgaagacatttcccaagtgcttcatgttagccagcaaatctgacccacaaggcctggaaagaggtgattgttaggttgcgcagaggtggtcttatccagctcagcttcccctgggacccaccgtgggacctgaggcagaactggggtggacttggcctcctccatggcacaccggctgcagatacgactgctgacgtgggatgtgaaggacacgctgctcaggctccgccaccccttaggggaggcctatgccaccaaggcccgggcccatgggctggaggtggagccctcagccctggaacaaggcttcaggcaggcatacagggctcagagccacagcttccccaactacggcctgagccacggcctaacctcccgccagtggtggctggatgtggtcctgcagaccttccacctggcgggtgtccaggatgctcaggctgtagcccccatcgctgaacagctttataaagacttcagccacccctgcacctggcaggtgttggatggggctgaggacaccctgagggagtgccgcacacggggtctgagactggcagtgatctccaactttgaccgacggctagagggcatcctggggggccttggcctgcgtgaacacttcgactttgtgctgacctccgaggctgctggctggcccaagccggacccccgcattttccaggaggccttgcggcttgctcatatggaaccagtagtggcagcccatgttggggataattacctctgcgattaccaggggcctcgggctgtgggcatgcacagcttcctggtggttggcccacaggcactggaccccgtggtcagggattctgtacctaaagaacacatcctcccctctctggcccatctcctgcctgcccttgactgcctagagggctcaactccagggctttgaggccagtgagggaagtggctgggccctaggccatggagaaaaccttaaacaaaccctggagacagggagccccttctttctccacagctctggacctttccccctctccctgcggcctttgtcacctactgtgataataaagcagtgagtgctgagctctcacccttcccccactaacca

SEQ ID NO: 2754 - DNA, 1497 bp, Homo sapiens
ccggcgcttgcgcacctccgcccgagctcgcgggccttgcggctgcgttttcaatctgcttccttgtgagtcaggtgggtcctgggcccaggaaccggcccggagccgtggacgccctacagctgagaaggggacccaaggggtcggccgcggccaaggcccctaggaccgccgccccagctcacgctgccgacggcagctatagacattctgcgtcaggtccgggctcctggacttcgcctttcccgagccctggaggtggggagaaaaggttcaccaatttttaaaatccaaatatatctcatggtacagtggaagaactggccagagagtctggaagtttgggttctggtcctggctgtgccactgactcactgtgaccttgggatcttgtgctgtgaagacatttcccaagtgcttcatgttagccagcaaatctgacccacaaggcctggaaagaggtgattgttaggttgcgcagaggtggtcttatccagctcagcttcccctgggacccaccgtgggacctgaggcagaactggggtggacttggcctcctccatggcacaccggctgcagatacgactgctgacgtgggatgtgaaggacacgctgctcaggctccgccaccccttaggggaggcctatgccaccaaggcccgggcccatgggctggaggtggagccctcagccctggaacaaggcttcaggcaggcatacagggctcagagccacagcttccccaactacggcctgagccacggcctaacctcccgccagtggtggctggatgtggtcctgcagaccttccacctggcgggtgtccaggatgctcaggctgtagcccccatcgctgaacagctttataaagacttcagccacccctgcacctggcaggtgttggatggggctgaggacaccctgagggagtgccgcacacggggtctgagactggcagtgatctccaactttgaccgacggctagagggcatcctggggggccttggcctgcgtgaacacttcgactttgtgctgacctccgaggctgctggctggcccaagccggacccccgcattttccaggaggccttgcggcttgctcatatggaaccagtagtggcagcccatgttggggataattacctctgcgattaccaggggcctcgggctgtgggcatgcacagcttcctggtggttggcccacaggcactggaccccgtggtcagggattctgtacctaaagaacacatcctcccctctctggcccatctcctgcctgcccttgactgcctagagggctcaactccagggctttgaggccagtgagggaagtggctgggccctaggccatggagaaaaccttaaacaaaccctggagacagggagccccttctttctccacagctctggacctttccccctctccctgcggcctttgtcacctactgtgataataaagcagtgagtgctgagctctcacccttcccccactaacca

SEQ ID NO: 2755 - DNA, 867 bp, Homo sapiens
atggatattggcctgagtatagccaatagctcagggtttcaactgtctgagttcattctgatagggttcccaggcattcatgagtggcagcactggctctccctgcccttagctcttggtgccaatctcctcatcataatcaccattcaacatgagaccatgctacatgaacccatgtaccatttgctgggcatattagcagtggtggacattggcctggccaccaccatcatgcccaagatcctggccatcttctggtttgatgccaaggccatcagcctccctgagtgttttgctcagatctatgccatccactctttcatgtgcatggagtcaggcatcttcctctgcatggcagtggatagatatatggccatttgttatccccttcagtacacttccatagttactgaagcttttgtcatcaaagccacactgtcagtagtgctcaggaatggcctgttgaccatcccagtgccagtattggctgcccagcgacactactgctccaggaatgagattgatcagtgcctctgctctaacttgggggtcacaagtctggcctgtgatgacaccactattaacaggttttaccagctggccttggtctgggttgtggttgggagtgacatgggtctggtctttgcttcctattctttgattattcactcagtgctgaagctgaactctgctaaagcaacatctaaggccctgaatacctgcagctcccaccttatcctcattctctttttctacacagctattattgtagtatctgtcaccacctggcaggaagaagggctccccgcatccctgttctcctcaatgtgctgcatattgtcatcccctcagcccttaaccccatag

SEQ ID NO: 2756 - DNA, 1351 bp, Homo sapiens
cttcgccgcggcctgctccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccgggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacctaaaatattagaatatttattggagatttaaaatcatcttattctgacttaattaccgatatccccgaaggctaggttcattgaataatagaaaatttcattatgattgcttttaagaacagattcttcagctgatttagtgataagaatccagaaaagaaaatgtactagtgatgtattctctccccagatgaaattgctgccttattcagatttactctcttgagccagattttgaatttcactgcagactgcttcagacttctaatcataggcttgtaaacctactaataggctctgcccctcttcccaatactttttgtcatttagagatataaaccggggcatataaaaatgcaacttgtattcctttgtatatttttccctgtctgacttataaatcttgagacctttattgtaaaagcatgtatcatcaggtgagaaatataaataggaactggggtcattgagcctcaggtagggaatatatcaacccgatttcttcctctcttttcccttttataggataaataatcc

SEQ ID NO: 2757 - DNA, 1615 bp, Homo sapiens
gaagtgggggaggaggaggaggagttggaaggggaggaggaagagggggagcaggaagaggggcagaaggaagaagaagagggggaggagaaagagatagaagagtaagaggagggggaagaaagacaaggggaaggggaggaggaggaggacggggaggagcttcgccgcggcctgctccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccgatgtgtacgcctagccctggttcatgatatggcagaatgcatcgttggggacatagcaccagcagataacatccccaaagaagaaaaacataggcgagaagaggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacctaaaatattagaatatttattggagatttaaaatcatcttattctgacttaattaccgatatccccgaaggctaggttcattgaataatagaaaatttcattatgattgcttttaagaacagattcttcagctgatttagtgataagaatccagaaaagaaaatgtactagtgatgtattctctccccagatgaaattgctgccttattcagatttactctcttgagccagattttgaatttcactgcagactgcttcagacttctaatcataggcttgtaaacctactaataggctctgcccctcttcccaatactttttgtcatttagagatataaaccggggcatataaaaatgcaacttgtattcctttgtatatttttccctgtctgacttataaatcttgagacctttattgtaaaagcatgtatcatcaggtgagaaatataaataggaactggggtcattgagcctcaggtagggaatatatcaacccgatttcttcctctcttttcccttttataggataaataatcc

SEQ ID NO: 2758 - DNA, 3413 bp, Homo sapiens
ggaaagtcctaggggtgggggcagtctccacagcctcccacaagggagttaccaccttcccgcacttctgggtacaagtctcctgctctggctgtattccacagttagaacttcatatctttggcttagagctggattttctgttaccatgtggatgctccaggtgaaggggcccgctcctgcttaaaaacaccatgcatgcagactgctgctgggaatgtgacagttggctgttggagagaagcgggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccattccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagctatggtatcagcctgcactccagcacccatgagcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagcaaccctgcgaagaaggaattgtgatactcatgcttaggatctcatgggaaaggcaacaacaagcagtcacaggggctcggagctggagagtgacacactcagctttgccacatggtgctgatggacatcagacggagacttccagcaatctgttggttttgcaagtctga

SEQ ID NO: 2759 - DNA, 4216 bp, Homo sapiens
agtgtgaaggttaaggaaggcttcctggaggagatgacatttaaactgaaccttaaagtttgccaaatgaacaagaggcagcatgggcatcctaggtacttttgtcatcttttctgccactgcaggtgggctatgagttgggagaagggaccatgtcacattggtattgcacccccaggtccagctttaggagggccccaagaagtggggatgggatggatgaaggagtgcctgaacaaatactgcaggtcaccagcagaatgtgtcacctccagggagagcaaacctggccttggggtcgggagtcctgggttccagccccagctccatccagttctaactccaatttccctgaccatggtgagggaaagagaaagggaaactaccattacttacaggcctactatgtgccaaacacttgtattgacctctttcaaatgttatttcactaatctgcacagcaaccctgcgaagaaggaattgtgatactcatgcttaggtgagttaaggggaattttttaaggtcacagagctcagagagtccagagagattcagaacaggcctgcctgacacggtcctctactttggtcagcctcttggagaggcacttctaagtctgttagtgtctaccacatgggttcttgcaggagaggagggagggtggatcttgccagaccttatggggcattcctgtgtccaccacaaagtcagggactctaggtttaacttctccccaccattccctggactcctgaccagcagcccttccgccctgcagcaagggtcttggcccaggttcagtcttttccacctccccagaagaggtgtctgctcctggccagtcagccccaccattaaagccgtggcactttgatgcagctcagatgcccctttcaccctcgtcccctccgccccggcttcctgtcgccctctctgctgtgatggtgtgtgtgcttgcttctcccagtggaaggtgaactccttaagggagctgtgccatcttggacaagtcacttaacctgcctgtgcctctgtttcctcacctgtagtatggggatgatgacttgaccacctcctagagtggtcaggtttacataaagcacttagaacagtgcctggcacataggaagtgctctctgtgagtcagttaaattgcttttagggttctcatgactcttttccgtgtctccagtgcccagcccagaagctgtgcacagcaggcctgaatattggtggtgtgaattggtggatggcgggtgataggtggagcccctccttttctgcctcctcccccggtgacctgtcctgccccctcctccagctctgcctccccagctctttcctcccacaatacagacacacgggctcaacagtcacaggagatgtcaggcaagggcatggaggggagaagcgtttgtgagagtcatgcagcaggcatcgaagtcctgttggctgccgtgggtggggaggccagtgggggagaggagggggataagggtgaggctggtgtgcagcttggacgatggggggctggtagtgctaaccctgccacagggagtgcaagaggagggcatgcctaaggaggaaaggagccaagtttctttcttttttttttttttggacggcgtttcattcttgtctcccaggctggagtgcaatggcgccatcttggctcactgcaacctccccctcccaggttcaagtgattctgatgcctcatcctcctgagtggctgggattacaggcacctgccaccatgcccagctaatttttgtatttttagtagagatggggtttccccatgttggccaggctagtctcaaactcctgacctcaggtgatttatccacctcagtctctcaaagtgctgagattataggtgtgagccaccttgcctggccttttctttctttctttctttctttctttctttctttctttctttctttctttctttctttctttcttttctttctttctttctttctttctttctctttctttctttctttctctccctctctttctttctcctttcttccttctttcccctttccttccttccttcctccctccttccctccctccttctctctctttatttctttctttatttccttctcttttcaaggtggagtcttgctcttgtcacccaggctagagtgcagtggtgtgatcttggctcactgcaacctccacaccctagattcaagcgattctcctgcctcagcttcccgagtagctggggcgtgtgccaccgtgcccggctaattttttgtatttttagtagagatgggggtttcaccatgttgcccaggctggtcttgaactccatacctcaggtgacccacccaccttggcctcctgagtagctgggattacaggcatgagccaccgtgcccggcccaagccaagattcatgttggacctgaactcatgcagcaagcagtccctgagcacatattccgcaccagagttgatgttagctaacaggggcccatggaggaacaactcgggttttgtcctcagggaaatcccctgttggataggggaggcagatggaggcactgaaggtttccagctgtcgcctcaggaggaagtccagggcacccaagggcccagggaaggaggcagtcagcctaaatgaggccaggggcagtgtcaagcctagctttaaggctctgagttttggatggagccctgcgaggtggcaggggtcagagtggaggtgggcatcccaggagaagggcattttgccagcacagaaggggtggaacagcctgggtagttcagagaacaggagacagcttggttggaagctggctggctggtggtgagggtgtgggctggagggtgggcacgctgctgttaatgaggccacaggatctcatgggaaaggcaacaacaagcagtcacaggggctcggagctggagagtgacacactcagctttgccacatggtgctgatggacatcagacggagacttccagcaatctgttggttttgcaagtctgaagctccgggcagagctgagcctggtatccaatgtgcaatcccagtgcatgggaggccagggggctgccctgcccccctcagcctgggaagtaatgaccctttgctccctcagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggtcgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggcttacctctc

SEQ ID NO: 2760 - DNA, 3413 bp, Homo sapiens
agtctccacagcctcccacaagggagttaccaccttcccgcacttctgggtacaagtctcctgctctggctgtattccacagttagaacttcatatctttggcttagagctggattttctgttaccatgtggatgctccaggtgaaggggcccgctcctgcttaaaaacaccatgcatgcagactgctgctgggaatgtgacagttggctgttggagagaagcgggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccattccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagctatggtatcagcctgcactccagcacccatgagcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagcaaccctgcgaagaaggaattgtgatactcatgcttaggccacaggatctcatgggaaaggcaacaacaagcagtcacaggggctcggagctggagagtgacacactcagctttgccacatggtgctgatggacatcagacggagacttccagcaatctgttggttttgcaagtctgaagctccgggcagagc

SEQ ID NO: 2761 - DNA, 5890 bp, Homo sapiens
ggaaagtcctaggggtgggggcagtctccacagcctcccacaagggagttaccaccttcccgcacttctgggtacaagtctcctgctctggctgtattccacagttagaacttcatatctttggcttagagctggattttctgttaccatgtggatgctccaggtgaaggggcccgctcctgcttaaaaacaccatgcatgcagactgctgctgggaatgtgacagttggctgttggagagaagcgggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccattccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagctatggtatcagcctgcactccagcacccatgagcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgaggatggagtttcactcttgttgcccaggctggagtgcaatggtgcgatctcggctcactgcaacctctgcctcccaggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttattgcaatacaaatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggtcgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagcaactcctagagggcagagatttcatctgctctgcccaccgctatatagccagccactagaacaggccggaagcgcagaaagagctaagaatttgaaaaggtccccctatttatgtcgagagcgccatcagaaattgatcccagggagaatcctgacttggcttgtctccagtcaattatttttgatgaggagcgttctccagaagaacaggccaagacctataaagatgagggcaatgattactttaaagaaaaagactacaagaaagctgtaatttcatacactgaaggcttaaagaagaaatgtgcagatcctgatttgaatgctgtcctttataccaaccgggcagcagcacagtactatctgggcaattttcgttctgctctcaatgatgtgacagctgccagaaagctaaaaccctgccacctcaaagcaataataagaggtgccttatgccatctggaactgaaacactttgccgaggccgtgaactggtgtgatgagggactgcaaatagatgccaaagagaagaagcttctggaaatgagggctaaagcagacaagctgaagcgaattgaacagagggatgtgaggaaagccaacttgaaagaaaagaaggagaggaatcagaatgaggctttactccaggccatcaaggctaggaatatcaggctctcagaagctgcctgtgaggatgaagattcagcctcagaaggtctaggtgagcttttcctggatggactcagcactgagaacccccatggagccaggctgagtctagatggccagggcaggctgagctggcctgtgctctttctgtacccagagtatgcccagtcggacttcatctctgcttttcatgaggactccaggtttattgatcatctaatggtgatgtttggtgaaacaccctcttgggacctagagcaaaaatattgccctgataatttggaggtctactttgaggatgaggacagggcagaactataccgggtgcctgccaagagcaccttgctacaggttctacagcaccagaggtactttgtaaaagccctgacaccagcatttttggtctgtgtaggatcctctcctttttgcaagaattttctccgggggagaaaggtgtaccagatacgatgactaagccagggcccctggatctcctcccttaccctcctctgctgggaacctagcacacctgaatcagctggacatactgctggagtccagtgctttctttccgtcaccctggggatagtccttcctggcatcgtggtgggggaggagcctctggcttccctaaactgcagcctctctggctggtcttcactttcctcagttgatataaaactctgggtcttggccatgatgtccttggactccatcgctaaagggaccatctgctgcagttaccacagcaactgacctgagcggcaccctggtctgtggagatggactcaggatccagtgacatgattctgaacttttgtggagtttgacaccttagagaagctacccctcaaactgcacatctacacacaaacaaacaatgcataggattccaaggctttaaagctgagagaccctggcctcaagttatttcatgcgcacagagggaagccatgtggggttgctgaagatgccttgaggtgaaatgggggcaggaaagccacatcttgctctgcatttataaagaccgtacaaactcagatccttggtacccctaaaaagattgccaattttcttcatctttgccatatggaggactgtgacagactttggacagtggcctcttgagttcctctgcagttttgacatttaggattttgtgtcttttaaactggaaaatcttctagc

SEQ ID NO: 2762 - DNA, 4329 bp, Homo sapiens
agctctgggaaagtcctaggggtgggggcagtctccacagcctcccacaagggagttaccaccttcccgcacttctgggtacaagtctcctgctctggctgtattccacagttagaacttcatatctttggcttagagctggattttctgttaccatgtggatgctccaggtgaaggggcccgctcctgcttaaaaacaccatgcatgcagactgctgctgggaatgtgacagttggctgttggagagaagcgggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccattccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagctatggtatcagcctgcactccagcacccatgagcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggtcgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggctt

SEQ ID NO: 2763 - DNA, 2975 bp, Homo sapiens
ctaggggtgggggcagtctccacagcctcccacaagggagttaccaccttcccgcacttctgggtacaagtctcctgctctggctgtattccacagttagaacttcatatctttggcttagagctggattttctgttaccatgtggatgctccaggtgaaggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggtcgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggcttacc

SEQ ID NO: 2764 - DNA, 1886 bp, Homo sapiens
agctctgggaaagtcctaggggtgggggcagtctccacagcctcccacaagggagttaccaccttcccgcacttctgggtacaagtctcctgctctggctgtattccacagttagaacttcatatctttggcttagagctggattttctgttaccatgtggatgctccaggtgaaggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagctcctccagatggagcaggtgcgccggatccccgaggaatactctctggggcggatggcagaaggcctgagccaccacgaccccatcatgaa

SEQ ID NO: 2765 - DNA, 3986 bp, Homo sapiens
gccgggaggagtgggggcggtgcctcacgtctggtacagtcatcacaagcctgttcggcgggactgtgatggccagagagatgacgatcttaggatcggctgttttgactctcctgttggccggctatttggcacaacagtatttaccattgcctactcctaaagtgattggtattgatcttggcaccacctattgttctgttggggtgttttttcctggcacaggaaaagtaaaggtgattccagatgaaaatgggcatatcagcatacccagcatggtgtcttttactgacaatgatgtatatgtgggatatgaaagcgtagagctggcagattcaaatcctcaaaacacaatatatgatgccaaaagattcataggcaagatttttaccgcagaagagttggaggctgaaattggcagatacccatttaaggttttaaacaaaaatggaatggttgagttttctgtgacaagtaatgagaccatcacagtgtccccagaatatgttggctctcgactattgttgaagttaaaggaaatggcagaggcatatcttggaatgccagttgccaatgctgtcatttctgtaccagcagaatttgatctaaaacagagaaattcaacaattgaagctgctaaccttgcaggactgaagattttgagggtaataaatgaacccacagcagcagctatggcctatggtctccacaaggctgacgtcttccacgtcttggtgatagacttgggcggaggaactctagatgtgtctttactgaataaacaaggagggatgtttctaacccgagcaatgtctggaaacaataaacttggaggacaggacttcaatcagagattgcttcagtacttatataaacagatctatcaaacatatggcttcgtgccctctaggaaagaggaaatccacagattgagacaagctgtggaaatggtcaaattaaatctgactcttcatcaatctgctcagttgtcagtattactaacggtggaggagcaggacaggaaggaacctcacagtagtgacactgaactgccaaaagacaaactttcctcagcagatgaccatcgcgtgaacagtgggtttggacgtggcctttctgataagaaaagtggagaaagtcaggttttatttgaaacagaaatatcacggaaactctttgatacccttaatgaagacctctttcagaaaatactggtacccattcagcaagtattgaaagaaggccacctggaaaagactgagattgatgaggtggttttagttgggggctccactcgtattcctcggatccgtcaagtcattcaagagttctttggaaaagatcccaacacatctgtagaccctgacctagcagtagtaacgggagtggctatccaagcagggattgatggaggctcttggcctctccaagtcagtgctttagaaattcccaataagcatttacaaaaaaccaacttcaactgaattctgcagaaataatggttatttgtgaacttgtctgatgatctcttcccatttatcagattaccttttccacaaaagaaagtctctaaaatatcacagatttacctagagggcaacatttagatacaggaaaattttacatagtgttttgtcttaggattagacgtgaccagattgatcctgtttgattttggagagatcctattctaacaaatactctaaaatgataaaattgaggtacaactctcttaaaagagtatggataactatattttctggattctggaggttgataaccatatgcacttaacattatattctataaacattaagtagtgccagttatgagattcccagttcttactaaattgtattagcaggagctggtaattacttgtattatcacatgtaactaataatttgaactatacttgaaggaccgtgttgatgtcaggtatttacagtggttggaagatagcagtattattagcataagctgcatacgtaatattcagtaactgccatattatataacaaatttacattcacaaattcagtatcctgttaagtgtcatattcttgtaatctgcattctccaggagttttatgtgtttaatagatgaatttattttatttctaaaggtattcaaatgtttcagcaccatataatagaaatacccaattatattctagttcctttatgtcctgtacatcattctctgcttggatttccattattctgtttggttagagaataaaattggtaattgcatttgaagaatgtgttaatgtcataataaagccatgattgctatcttatttttgttatccgagacctttgcaaacattggcaaatagcatcaattacctactgtatttgtttctttgtttatattttcagtaagccctggggaatatagcatggaattgagctactaaatggttttggttccgttttacggagatttttcctcatatttagttttgaatgaggaaaatgtgctcaattataaaagctgtgttattgttttctattattatttttaaataatcacacttggactcttttcaaacattaggttagtttgtaatgaaagcaaaaaatttgtgaatactggaagtaacgtggaaatctaatgtggaagccattgtggcaaggtttctacaaatcggcatttggagcagagttgtttgtttttgttgtttgtttcctttaagaaaaaccacagggaccaagaaagaaaatataacagtttgatttctgtcatacccattgtatttgaagatatatggatacagattatatatatatatacatattttccttaatagaggaatgcttcatattattcaaaaattatatcctgatcacctttttttgttttttattgtaaagtatctctgctttatccattgctgaattcgataggatgttgaaatgctggtcaccaaaaaaggaaactgagcaaattcatttcaacaacatcaaaacttcagcttctcatagtaaaaagctgaatgttactaatatttttcatatctaaaaaaaaattcttagcaatgaaattgctgttaaaacacaaatttcaatcaaatacttttgtgtatagaaaatatgtatagtaggtagatagaaaagtataaaatgtttgttgaagtatcttattttagaatgaatggagaaatgccaaagatgaatccttcactgcattatgaaaatatttcacatgttctcttggactttatataaatctgtaatagattttagaattgaaaaattctttgtgaaggtcttctaaaagtgttccaatttatctcaaaatctccatatataggatcagcttaaaacataaagaaaaccttgaatttctcaaatgtttgagatgttcaagacagtctcttaatccgttaatgcttttggaaacaattgacaaaatagggcaggcagctcatctcatgtcctgaagttggaatttaaataattcctatttgcaaattagaatgacagtgttggaatttggaggcagtagttgagcatattctctagtatatagctacacctttaataaaatgaaggaatgtcttcaatcatattttagtgggctatttataaatagtcttgaagtcaatttagtttatttatttaaaagataatgcatcctgaaagggatcatttatgaataacaatctgaagtcttttcataaaaaaaattaataaactttagttgtacatttagccagtgttatttgaagtatgtaacttttaaaatattaagtgtcttgtatgattagaatatgtgaatgagtaacttattttgtatcaggaatgttttggtactgtgttttcactcaaaccactgacttaacagatactgctgtgtataacatgtactaaatattacagttattgtgcataacagattgttcctcttatatttgtgtgtatacaggcaattcatgttttaatgtaaataaataccattttgcagtttgttttttaaa

SEQ ID NO: 2766 - DNA, 1299 bp, Homo sapiens
ctgttcggcgggactgtgatggccagagagatgacgatcttaggatcggctgttttgactctcctgttggccggctatttggcacaacagtatttaccattgcctactcctaaagtgattggtattgatcttggcaccacctattgttctgttggggtgttttttcctggcacaggaaaagtaaaggtgattccagatgaaaatgggcatatcagcatacccagcatggtgtcttttactgacaatgatgtatatgtgggatatgaaagcgtagagctggcagattcaaatcctcaaaacacaatatatgatgccaaaagattcataggcaagatttttaccgcagaagagttggaggctgaaattggcagatacccatttaaggactgaagattttgagggtaataaatgaacccacagcagcagctatggcctatggtctccacaaggctgacgtcttccacgtcttggtgatagacttgggcggaggaactctagatgtgtctttactgaataaacaaggagggatgtttctaacccgagcaatgtctggaaacaataaacttggaggacaggacttcaatcagagattgcttcagtacttatataaacagatctatcaaacatatggcttcgtgccctctaggaaagaggaaatccacagattgagacaagctgtggaaatggtcaaattaaatctgactcttcatcaatctgctcagttgtcagtattactaacggtggaggagcaggacaggaaggaacctcacagtagtgacactgaactgccaaaagacaaactttcctcagcagatgaccatcgcgtgaacagtgggtttggacgtggcctttctgataagaaaagtggagaaagtcaggttttatttgaaacagaaatatcacggaaactctttgatacccttaatgaagacctctttcagaaaatactggtacccattcagcaagtattgaaagaaggccacctggaaaagactgagattgatgaggtggttttagttgggggctccactcgtattcctcggatccgtcaagtcattcaagagttctttggaaaagatcccaacacatctgtagaccctgacctagcagtagtaacgggagtggctatccaagcagggattgatggaggctcttggcctctccaagtcagtgctttagaaattcccaataagcatttacaaaaaaccaacttcaactgaattctgcagaaataatggttatttgtgaacttgtctgatgatctcttcccatttatcagattaccttttccacaaaaga

SEQ ID NO: 2767 - DNA, 1750 bp, Homo sapiens
agggcctgaatacacagagcgctgagagagtggggcagtgtggtcacggacacaggtcatgggggccttggcaggagcggttttggcagagggtggggccggtgcctctggaaggtatgaagatgtaaatgaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcgctggcctagcctattcaaacctggtgtatgactgggtgaaggcggccgtcctctttggtgttgtcaacactgtggcatgcctcgaccacctggacccaccccagcctcccaagtgcatcaccgcactctacgtctttgcggaaacgcactttgaccgtggcatcaacgactggctttgcaaatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctggatgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 2768 - DNA, 1735 bp, Homo sapiens
agggcctgaatacacagagcgctgagagagtggggcagtgtggtcacggacacaggtcatgggggccttggcaggagcggttttggcagagggtggggccggtgcctctggaaggtatgaagatgtaaatgaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctctccccagcgacctcaagttcgccaaccgcctcccagacagtgccctcggctggcctagcctattcaaacctggtgtatgactgggtgaagggccgtcctctttggtgttgtcaacactggcatgcctcgaccacctggacccacccccctcccaagtgcatcaccgcactctacgtctttgcggaaacgcactttgaccgtggcatcaacgactggctttgcaaatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctggatgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttct

SEQ ID NO: 2769 - DNA, 915 bp, Homo sapiens
agctctgcagcactcggctctgctccactctgctcagctccgctccaggaaggccacctcctcctccccctcctcctcccgctgtcaccactcaccgctcataacctcaagggggtggggaccccagggctggacacaccccaccgtggccccagagctcagccggtcgcacggacggacagttggaagccggaccccagagcctgagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcagg

SEQ ID NO: 2770 - DNA, 1865 bp, Homo sapiens
agcagctctgcagcactcggctctgctccactctgctcagctccgctccaggaaggccacctcctcctccccctcctcctcccgctgtcaccactcaccgctcataacctcaagggggtggggaccccagggctggacacaccccaccgtggccccagagctcagccggtcgcacggacggacagttggaagccggaccccagagcctgaggtgggcagtgtgccagggtcccttgcggcctcctcaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcgctggcctagcctattcaaacctggtgtatgactgggtgaaggcggccgtcctctttggtgttgtcaacactgtggcatgcctcgaccacctggacccaccccagcctcccaagtgcatcaccgcactctacgtctttgcggaaacgcactttgaccgtggcatcaacgactggctttgcaaatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctggatgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 2771 - DNA, 507 bp, Homo sapiens
cttgacaccagcagggtgacatccgctattgctacttctctgctcccccacagttcctctggacttctctggaccacagtcctctgccagacccctgccagaccccagtccaccatgatccatctgggtcacatcctcttcctgcttttgctcccagtggctgcagctcagacgactccaggagagagatcatcactccctgccttttaccctggcacttcaggctcttgttccggatgtgggtccctctctctgccgctcctggcaggcctcgtggctgctgatgcggtggcatcgctgctcatcgtgggggcggtgttcctgtgcgcacgcccacgccgcagccccgcccaagaagatggcaaagtctacatcaacatgccaggcaggggctgaccctcctgcagcttggacctttgacttctgaccctctcatcctggatggtgtgtggtggcacaggaacccccgccccaacttttggattgtaataaaacaattgaaacacc

SEQ ID NO: 2772 - DNA, 504 bp, Homo sapiens
cttgacaccagcagggtgacatccgctattgctacttctctgctcccccacagttcctctggacttctctggaccacagtcctctgccagacccctgccagaccccagtccaccatgatccatctgggtcacatcctcttcctgcttttgctcccagtggctgcagctcagacgactccaggagagagatcatcactccctgccttttaccctggcacttcaggctcttgttccggatgtgggtccctctctctgccgctcctggcaggcctcgtggctgctgatgcggtggcatcgctgctcatcgtgggggcggtgttcctgtgcgcacgcccacgccgcagccccgcccaagatggcaaagtctacatcaacatgccaggcaggggctgaccctcctgcagcttggacctttgacttctgaccctctcatcctggatggtgtgtggtggcacaggaacccccgccccaacttttggattgtaataaaacaattgaaacacc

SEQ ID NO: 2773 - DNA, 8031 bp, Homo sapiens
agaacctcccagcttccggaatagaggagcggggcagaaatatcctgctttttatttcagagctgacgtttgcaatcctagtgcactagcggaaaaaaaaaaaaaaaaaaaaaaaaaaaaaagctgaattttccgcgctctcctggcaaattggcgtccgctctccgacgctaaaccaaaggaaaaggagtgttcaatggcgacagggcgctctttgaagccggctcctcacgcggattctggcccaggccgccgctccggtcccagtccggctgcagagcgaattggagaggatggcacctcctgcttcccggggggcggaaggagcgccagcgcctaaggtgggtcacctgccaggaagggaatacgcatggtgcagactcacgtgggaggagcacaggtcccgggtacaagtgccgagctggcgacttagagaagaggtagactcgggctcagaccaagcaggcgtaagggagtagacgggacgtcccgtgtttgcagtgacggcggagtcacccatcccagcagcctcaccttcttggagcgctggtccctccccttggactgaaaccccaggggccaccgcaccgggtgggcgggaccgactactacccgaccagccgctggagctgcgtgccaggcggggctgtgcggagcagctgagcgcagagcggagcaccaggcacctagcgggccggactctgggcggcacccgagcgggccgggcagcagtgggcgctcgcgatcctcctctgcccaacgcgctctccctccgggcccggcctcctccgtcccctccttttgctcccgctcctcctcccgctcctccccctcctcgggattgagcaccaaaacgcccgcctgcaaggtcctctgcgccctggcagccaggagtcgccgccacgacagccgggtctcagtgggtgcctgcgccttctccccgcccgcctgccccgggccatccagaaacttgctctacccgccgcgggtgctcggcagtgctgcccatggcccagcctaggagcctatttagggcgccggacgggctggacagaggcgcggctcagtaattgaaggcctgaaacgcccatgtgccactgactaggaggcttccctgctgcggcacttcatgacccagcggcgcgcggcccagtgaagccaccgtggtgtccagcatggccgcgctgctcctgggcgcggtgctgctggtggcccagccccagctagtgccttcccgccccgccgagctaggccagcaggagcttctgcggaaagcggggaccctccaggatgacgtccgcgatggcgtggccccaaacggctctgcccagcagttgccgcagaccatcatcatcggcgtgcgcaagggcggcacgcgcgcactgctggagatgctcagcctgcaccccgacgtggcggccgcggagaacgaggtccacttcttcgactgggaggagcattacagccacggcttgggctggtacctcagccagatgcccttctcctggccacaccagctcacagtggagaagacccccgcgtatttcacgtcgcccaaagtgcctgagcgagtctacagcatgaacccgtccatccggctgctgctcatcctgcgagacccgtcggagcgcgtgctatctgactacacccaagtgttctacaaccacatgcagaagcacaagccctacccgtccatcgaggagttcctggtgcgcgatggcaggctcaatgtggactacaaggccctcaaccgcagcctctaccacgtgcacatgcagaactggctgcgctttttcccgctgcgccacatccacattgtggacggcgaccgcctcatcagggaccccttccctgagatccaaaaggtcgagaggttcctaaagctgtcgccgcagatcaatgcttcgaacttctactttaacaaaaccaagggcttttactgcctgcgggacagcggccgggaccgctgcttacatgagtccaaaggccgggcgcacccccaagtcgatcccaaactactcaataaactgcacgaatattttcatgagccaaataagaagttcttcgagcttgttggcagaacatttgactggcactgatttgcaataagctaagctcagaaactttcctactgtaagttctggtgtacatctgaggggaaaaagaattttaaaaaagcatttaaggtataatttatttgtaaaatccataaagtacttctgtacagtattagattcacaattgccatatatactagttatatttttctacttgttaaatggagggcattttgtattgtttttcatggttgttaacattgtgtaatatgtctctatatgaaggaactaaactatttcactgaaaaaaaaaaaaagattttttctggagacgctatgtttttttgaatataattaacttgcccccaactcaaaatagctgtctgtgttgcaatcattgcaaaatctaaattcttttgttacttaaaaaaacatgtttttcatggctattacaatcctctctctcccctctcctttctgcattgctctttttaatttttaatgtctcattgtgatcatcagatttatttttacttggattgtaagatttatctcctcggcgattccttgtcatttttggaggtcacagttttactcattcccatgtgtaaacttcaagtaaacaaagcaatattcaggatggagaagcagttagtgactggctagaggtctcttgggatccatcttgacctcaaagaatatttgcacatgcttctgatctcagcagttataataaagaggattaaacccttggccttcagaatgatcttggacctggatactttgccccaggtggcagctggcctccagaaagccaattagaatagaaaagagaaactgcgaaatctatgcgtgtcttcatcctgtcggttctgtgaaaggctgactaaaagggtagtagtcttttgcttagtctgaaagtctgcttacttcctgaaagacacattggcattatagacatatattccatatgcactgagacataaatatgtgtatgtttcaaaatcaactctaaatttggagtcctgaatgtgaaagaaaaagtaagttcccaagtgttgaagttaaaaagagaaaagggcagagttgaaggtagcacctaagagaaccactgtacctgcccccagaggagtggctggagttcagttttacttctgcccctgagcagccagcttgttggagatggtcacataaacccttcttatcctcagttttttcatgcattcttcatgcagtcagccttttacagaattaaacccattggattttaataaaaataaaacattcattacagtaaaagagaaaatacaaacaagcaaaataaaccggcttcctgacatggtttataccgcaggaaaatgacagaaatggacgttattaatcatctcctacacttaagaactcattgaaatttctccaagcaaccccaggatgcagatattattatggaaatttcaaagaggaggaattaggcccagagaacatgagaaacttgcccaaggtcacattgactataaactcaggcttagaggctactcagagccaaagcacaggttatttatgtatttagtttttacccaactctttctgaactcaaaaggaaaagcccagactcagagccagttcttcctgacctgacttaacatttcttcccaggtgccaaatatcttccatcctaagaggtgtgtcccagatacaggaagggcaagaagaagcctgcatttttctcagcagtgttatcagggaagtgagtcaccttggtacgtttcagcagctccagcctgacctgaccttagcatggcctatgccccaccccatatcatgaacagagagcagagaggatgccttcctctttagaatccattgaagttgtcattaagccatcatctcccccagaggaagtagcagaaatatttacagcaggcccctggtggacatggtacttttcaataggcagagagcctccctctgcagcacatcgttggatcttgcttttaccatactccttgaagagctgaagaaataagagggcccagcaaggttaagtcaagtttccaagcctgttcaggaatatggtgactgaaaggaaactgcaatgagagtctctgactgaagaagatgctctttgcaaactgcctgtaaattcctgtcccctgacagggatggtctggtagaagcatgaactgtggatgcaagaggcagcggggaggagtggaggaagacaggaccagcacatggaatataatctagctgctgggactggcatagtcgatggaggcggtggtccagtgtaaaatgatcagtgaatgtaaattcaatatgttttcatttgggggtgcagagtcgtggctaaaggaatgttcaaatgagtctaccatgagcaagggatcagaggtcctagtggcactatctgttcattcatttttggtacaaccccagccagtcattgagaaggtacactgtgtaagaaaccatcactccagacttacccaaggtatttattgctagatctcaccaagcactgtcaaattcaaaggaggccctgtagtagaccctgggctgtccttacagggccaaaatgcagtgactcaggagcctaatagcacccggtccctccaaaacatgccttctaccaattccattaacagagacaggtgtcagtggaaggggtgggtctcctgtccagaccaccccggcccgggagcagcctgggggatctaggtgggtccttccagagaggcaagtgagaacaactgaaccaagcctcagctattagatttggaatattcacacacttgacactccagagtcagaacagccccttccctttcccttcctcctggaatcagatagggttgaaatccttttaacaccatttggttatcagctcacaacctgaaggtttgcaagtttaggaaaagtgacatgcctctgagcacagggtgctttactccttctgtgcttggaggcttacccaactgaaaggagatggagggcaggagaggccgatgcctagcgtgcctgctgcttacaggggtggtgtcacaggtcaccattattcattaaaattttacttttttgatcccctaccacatgctcaacatggtattgagtcctcaagaatataaaaagaaaatacaacaggaaccagtagtcattaactgtttgttctggactttaataaaagtacagagggtcttggagtacaaaggcaaagacatttagctgtgtatagaatgggtgggggaatgtgttccatggtttggcattcagttcagcaacattcctgagagaaatcaactagcccccttatagagaagaggaaactgagatttaaaaagtggtcctggccgggtgtagtggctcacgcctgtaatcccagcactttgggaggccaagacaggtgaatcacgaggtcaggagttcaagaccagcctgaccaacatggtgaaaccccatctctactaaaaatacaaaaatgtgccaggcatggtggcgagtgcctgtaatcccagctactcaggacactgaggcaagagaaccacttgaacctggcaggtggaggttgcagggggccgagatgatgccactgcactccagcctgggcaacagagcaagactccatctcaaaaaaaaaaaaaaaaaaaaaagataaattaataataaaaaaataaaaaagtaatcctgacttcaagtcatttttttcagaagaaaggattcttgctcactccagggaaatagtccagaaatggaaaatgttgacatcacaaatcacaaaagaaggtgaaaaatatcagagaccctctccagaatgtcatttctcagaaatattaagaaatagagaatcttcccagaggtcgcatgtcagggcaggtcacttaacttgtgggccacagagaccctgaccttcctgtgggaaggcttcatggaggaattgccataaagctggggcacgcacgaatggcagtagtgtcaccagagcagggcattctgaacaagggaagcttgagacatgaagacagtggtcacggggagaggctgggggtagagggtagaggtaggcaagagatttgtctgagtggcatgtcaaatgtgttaaactcaatgagaagctactgctttccaaggctggagtgttggaagcttacttagcaggcacccatgtgaatttggctcctgtgcaggtgtatctgttgcataaaaatagctatcatttgttgcacacctgccatgtgcttggtattttaaatatattgcttctaacctatataacaaccctaggaagtagaaaatgggctactaattttacagaaaaataaactcagaaattaaagggcttgcccatgttgatagagccattacttcttacaaatgaaattttgtctccgatgtctctgctccttttcagtccatctatttgtgggtaagtggaggaagatataaagcatatgcatctgtctattaggcagagcctgtaagggaaattatgggcatctaggatttggagttggacagttagggtgatatcaagattaccttcaagcaaagcagtggctgggatttgatgcaacagggacgtgataaaacatgctcctaaccggcagcagctcatttcggaagactgagcctgagttaaaggccagagcaacataacagagttctccaaacagcacacagtgagagaaggccaaagctaaagaggacatcatcggatttagctgcttcactaaagtgttttgatgtagaaaatgaccttggtgctttagttatccctgatgtcaagacctttactctattttgcccaaatttctcagttagataacagcaaagagagagagccagaagacctgggtgtgcatcctagctgtaccaatcactgaccatgggatcttagattcagactctgagaacctccatttccttctccataaaaatgggcagatatgtactgtactctgttgggggaaaactccaactcaatgagataaagtaggtaaaaactataaacccagtgcatatgttacttagtggttaaaaacatttgggactttaggagacagaccaaaactggttttgaaccagtcggcagaaatgcgctgccttttttcctcctctgcttcccagctatgtgactgtagctattgctgttaatgctccatccagagctcatttaccagggaagtgctctcaaccccagctgccacaaagattgtcttctgtactattttctgaaggatttctcttagttggcaggagttttcttacctgaagatgcctgagaaatgttgtccaccccactcccctgctttcctagggttagggcatgactaatgattgactgacccatgtgggatggggcatgggggtagtagggtaacagtccaccctcattgcctccaggcaggacaacctctggtgcaactcatgctcagagctcctcgtgagatcaggctgaggctagacttctcctgaaactgtacttttacttatttcttccgaaacttcatccttttcccacattaccttactcatttcttctgctaccctattctcagtaaatgtgtttcccaagaaaacaggaatcccccctcagactttgcttctagaccatccactctaaagtcttaaccttgcatgcatgttttcttctctctgtattttacatgtataacgtgatcaacccacggagttattagaattcttccaattaaatgagatatagcagagaatgagtctattttattggctagcaaatagcaaagtgttaaattcaataatggctgaaattgttaccaagtagtaggctcttttattagcttatcggactaccaaaatagtataatgcatcaatatcaaacttaaatttcaacttcataaaacaattctgggcccaacaaatatgaaggtattgctccatcttatgtagcaacatcttgtatttctattgtttgataaatattccacttagaactaa

SEQ ID NO: 2774 - DNA, 496 bp, Homo sapiens
gacagggcgctctttgaagccggctcctcacgcggattctggcccaggccgccgctccggtcccagtccggctgcagagcgaattggagaggatggcacctcctgcttcccggggggcggaaggagcgccagcgcctaagtaattgaaggcctgaaacgcccatgtgccactgactaggaggcttccctgctgcggcacttcatgacccagcggcgcgcggcccagtgaagccaccgtggtgtccagcatggccgcgctgctcctgggcgcggtgctgctggtggcccagccccagctagtgccttcccgccccgccgagctaggccagcaggagcttctgcggaaagcggggaccctccaggatgacgtccgcgatggcgtggccccaaacggctctgcccagcagttgccgcagaccatcatcatcggcgtgcgcaagggcggcacgcgcgcactgctggagatgctcagcctgcaccccgacgtggcggccgc

SEQ ID NO: 2775 - DNA, 491 bp, Homo sapiens
ctaagaagaatcgaggctggagcaggtggagtggatgcagagggaaccaggaagcaaaggctggggattttcccatcctcctcacctcctgccctagcacctctgctctggaagtcccgagggaccggttgatcttaattgaaggcctgaaacgcccatgtgccactgactaggaggcttccctgctgcggcacttcatgacccagcggcgcgcggcccagtgaagccaccgtggtgtccagcatggccgcgctgctcctgggcgcggtgctgctggtggcccagccccagctagtgccttcccgccccgccgagctaggccagcaggagcttctgcggaaagcggggaccctccaggatgacgtccgcgatggcgtggccccaaacggctctgcccagcagttgccgcagaccatcatcatcggcgtgcgcaagggcggcacgcgcgcactgctggagatgctcagcctgcaccccgacgtggcggccgc

SEQ ID NO: 2776 - DNA, 1156 bp, Homo sapiens
atggcaggtagcggcggcctgggcggcggggccgggggcggccagggcgcaggggccgggcaaggggccgctctgcgggcgtcccgcgcgccgatgctgctcgtggccctggtgctcggcgcctactgcctctgcgccctccccggccgctgcccgccggccgcccgcgcccccgcgccggcccccgcgccctccgagccgtccagctccgtccaccgcccgggagcacccggcctgcctttggccagcggtcccggccgccggcgcttcccgcaagcgctcatcgttggcgtgaagaagggcggcacgcgcgccctgctggagtttctgcggctgcaccccgacgtccgcgcgctgggctctgagccccacttcttcgacaggtgctacgagcgcggcctcgcctggtaccggagtctgatgccccgaaccctggatgggcagatcaccatggagaagacccccagctacttcgtgacgcgagaggccccccgccgcatccacgccatgtccccggacacgaagctgatcgtggtggtgcggaaccccgtgacccgggccatctccgactacgcccagacgctctccaagaccccgggcctgcccagcttccgcgccctggccttccgccacggcctgggccccgtggacacagcctggagcgccgtccgcatcggcctgtacgcccagcacctggaccactggctgcgctacttccccctgtcccacttcctgttcgtcagcggggagcgtctggtcagcgacccggccggagaggtcggccgcgtgcaggacttcctgggcctgaaacgggtcgtcacggacaagcacttctacttcaacgccaccaagggcttcccctgcctcaagaaggcccagggcggcagccgtccccgctgcctgggcaagtccaagggccggccacacccacgcgtgccccaggccctggtccggcgcctgcaggagttctaccggcccttcaaccgcaggttctaccagatgacgggccaggacttcggctggggctgagcggcaccctggggatgctcagcaccttgattgacacccgctcgcctggccagagcgggctgcgtgcacatgctgggcagagaggaatatttaagaaataaagcttggacccagatttttccacaaa

SEQ ID NO: 2777 - DNA, 1063 bp, Homo sapiens
atgctgctcgtggccctggtgctcggcgcctactgcctctgcgccctccccggccgctgcccgccggccgcccgcgcccccgcgccggcccccgcgccctccgagccgtccagctccgtccaccgcccgggagcacccggcctgcctttggccagcggtcccggccgccggcgcttcccgcaagcgctcatcgttggcgtgaagaagggcggcacgcgcgccctgctggagtttctgcggctgcaccccgacgtccgcgcgctgggctctgagccccacttcttcgacaggtgctacgagcgcggcctcgcctggtaccggagtctgatgccccgaaccctggatgggcagatcaccatggagaagacccccagctacttcgtgacgcgagaggccccccgccgcatccacgccatgtccccggacacgaagctgatcgtggtggtgcggaaccccgtgacccgggccatctccgactacgcccagacgctctccaagaccccgggcctgcccagcttccgcgccctggccttccgccacggcctgggccccgtggacacagcctggagcgccgtccgcatcggcctgtacgcccagcacctggaccactggctgcgctacttccccctgtcccacttcctgttcgtcagcggggagcgtctggtcagcgacccggccggagaggtcggccgcgtgcaggacttcctgggcctgaaacgggtcgtcacggacaagcacttctacttcaacgccaccaagggcttcccctgcctcaagaaggcccagggcggcagccgtccccgctgcctgggcaagtccaagggccggccacacccacgcgtgccccaggccctggtccggcgcctgcaggagttctaccggcccttcaaccgcaggttctaccagatgacgggccaggacttcggctggggctgagcggcaccctggggatgctcagcaccttgattgacacccgctcgcctggccagagcgggctgcgtgcacatgctgggcagagaggaatatttaagaaataaagcttggacccagatttttccacaaa

SEQ ID NO: 2778 - DNA, 1146 bp, Homo sapiens
gctgcgggaccgccgggcgcagagcacaagccgggcacccacggactgagcggcgcgcgggccgagatgcgcgcccgcctgctgcccccgctcccgggcctggagcggcgcgaccccatggcaggtagcggcggcctgggcggcggggccgggggcggccagggcgcaggggccgggcaaggggccgctctgcgggcgtcccgcgcgccgatgctgctcgtggccctggtgctcggcgcctactgcctctgcgccctccccggccgctgcccgccggccgcccgcgcccccgcgccggcccccgcgccctccgagccgtccagctccgtccaccgcccgggagcacccggcctgcctttggccagcggtcccggccgccggcgcttcccgcaagcgctcatcgttggcgtgaagaagggcggcacgcgcgccctgctggagtttctgcggctgcaccccgacgtccgcgcgctgggctctgagccccacttcttcgacaggtgctacgagcgcggcctcgcctggtaccggagtctgatgccccgaaccctggatgggcagatcaccatggagaagacccccagctacttcgtgacgcgagaggccccccgccgcatccacgccatgtccccggacacgaagctgatcgtggtggtgcggaaccccgtgacccgggccatctccgactacgcccagacgctctccaagaccccgggcctgcccagcttccgcgccctggccttccgccacggcctgggccccgtggacacagcctggagcgccgtccgcatcggcctgtacgcccagcacctggaccactggctgcgctacttccccctgtcccacttcctgttcgtcagcggggagcgtctggtcagcgacccggccggagaggtcggccgcgtgcaggacttcctgggcctgaaacgggtcgtcacggacaagcacttctacttcaacgccaccaagggcttcccctgcctcaagaaggcccagggcggcagccgtccccgctgcctgggcaagtccaagggccggccacacccacgcgtgccccaggccctggtccggcgcctgcaggagttctaccggcccttcaaccgcaggttctaccagatgacgggccaggacttcggctggggctga

SEQ ID NO: 2779 - DNA, 2907 bp, Homo sapiens
agaatattagaacagagagccatgcatgtattatctaatacaattttctcattttataaattatataaatgaggaaactgagactcagcaaggttataggatacaacctaatctgtgttagaagaaggatgagagtgaggcttatgctgggagttgctatggtctgtaaatgtgaggataaggaacatgccattcactgttgtgttccacttcctagtccagtgcctggtgcaaagtaggggcttcataaactttggtcacaggcctgatgaagggactgatttgagtgaatgaatccatggatgatgcatctgtactttgtgttccccgctagtcagatggactcggacatgctccatttcaggtgtatctcatctgagacattattagagggttctctttatgtgccatgactgagtagcgttttcttccactgaagtattgcttcctctttgttgatatcacaggacagacatcagaacacttacaggatgtgtgtagtgtggcatgacagagaactttggtttcctttaatgtgactgtagacctggcagtgttactataagaatcactggcaatcagacacccgggtgtgctgagctagcactcagtgggggcggctactgctcatgtgattgtggagtagacagttggaagaagtacccagtccatttggagagttaaaactgtgcctaacagaggtgtcctctgacttttcttctgcaagctccatgttttcacatcttccctttgactgtgtcctgctgctgctgctgctactacttacaaggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccagccaaggtcacccctgcaccgactcggcagagagacttcactgcagcctttccaaggatgcttaccaccaggggacatggcccagcagagacacagacactggggagcctccctgatataaatctaacacaaatatccacattggccaatgagttacgggactctagattggccaatgacttacgggactctggagcaaccatcagaataggcatctacatcggagcagggatctgtgctgggctggctctggctcttatcttcggcgctttaattttcaaatggtattctcatagcaaagagaagatacagaatttaagcctcatctctttggccaacctccctccctcaggattggcaaatgcagtagcagagggaattcgctcagaagaaaacatctataccattgaagagaacgtatatgaagtggaggagcccaatgagtattattgctatgtcagcagcaggcagcaaccctcacaacctttgggttgtcgctttgcaatgccatagatccaaccaccttatttttgagcttggtgttttgtctttttcagaaactatgagctgtgtcacctgactggttttggaggttctgtccactgctatggagcagagttttcccattttcagaagataatgactcacatgggaattgaactgggacctgcactgaacttaaacaggcatgtcattgcctctgtatttaagccaacagagttacccaacccagagactgttaatcatggatgttagagctcaaacgggcttttatatacactaggaattcttgacgtggggtctctggagctccaggaaattcgggcacatcatatgtccatgaaacttcagataaactagggaaaactgggtgctgaggtgaaagcataacttttttggcacagaaagtctaaaggggccactgattttcaaagagatctgtgatccctttttgttttttgtttttgagatggagtcttgctctgttgcccaggctggagtgcaatggcacaatctcggctcactgcaagctccgcctcctgggttcaagcgattctcctgcctcagcctcctgagtggctgggattacaggcatgcaccaccatgcccagctaatttgttgtatttttagtagagacagggtttcaccatgttggccagtgtggtctcaaactcctgacctcatgatttgcctgcctcggcctcccaaagcactgggattacaggcgtgagccaccacatccagccagtgatccttaaaagattaagagatgactggaccaggtctaccttgatcttgaagattcccttggaatgttgagatttaggcttatttgagcactgcctgcccaactgtcagtgccagtgcatagcccttcttttgtctcccttatgaagactgccctgcagggctgagatgtggcaggagctcccagggaaaaacgaagtgcatttgattggtgtgtattggccaagttttgcttgttgtgtgcttgaaagaaaatatctctgaccaacttctgtattcgtggaccaaactgaagctatatttttcacagaagaagaagcagtgacggggacacaaattctgttgcctggtggaaagaaggcaaaggccttcagcaatctatattaccagcgctggatcctttgacagagagtggtccctaaacttaaatttcaagacggtataggcttgatctgtcttgcttattgttgccccctgcgcctagcacaattctgacacacaattggaacttactaaaaatttttttttactgtt

SEQ ID NO: 2780 - DNA, 5345 bp, Homo sapiens
atccacaaatgcctcggaagcagccagctggctgcatctttctcctcacattcctgggtctgtctgggctggttggcacagttaccagaacgtactacattgggattgtggaagaatactggaactatgtaccccaagggaagaatgttattactgggaaaagtttcacagaagacaaacttgcaaccttatttctcgaaagagggcccaacaggataggcagtatttacaaaaaggctgtttacagacgcttcacggatggaacctactccatagagatccccaaacctccctggcttggattcctgggccccatcttgagggccgaagtgggtgatgtgattgtcattcatttaaagaactttgcttctcgaccttactctctgcatccacatggcgttttctacaacaaagattcagaaggagccctatacccagatggaacatctggaaggaacaaaaatgatgacatggttcctcctgggaaaaactacacctacgtctggccggtgagagaagaatatgcacctactccagccgatgccaactgcctgacctgggtgtaccattcgcacatcgacgccccaaaggacatctgctctgggctaattgggcccctgctggtctgcaaggaaggtatcctgaatagatattcagggacacggaatgatgtggatcgagagtttgttataatgtttactcttgtggatgagaatcaaagctggtacctcaatgaaaatatcaaacatttctgcaccaaccctgattcagttgacaagaaagatgctgttttccagaggagtaacaaaatgcatgccctcaatggatacctcttcggaaacttcccggagcctgatatgtgtgttggagaatctgtgtcctggcacctatttggaatggggaatgaaatagacatccattctatctatttctatggtaacaccttcatcagcagagggcatcggactgatgtcgtcaacctgttcccagccaccttccttacaacagaaatgatagccgagaatcctgggaagtggatgataacctgccaggtcagcgaccacctacaagctggtatgctggggcaatacaatgttgataactgcaaaagtgatattttctaccccaagatgaagggtcaacagaggcgctactttatagcagctgaaaaaattctttgggattatgctcctcaaggctataacaaattcagtggtcttcctctaaacgcctctggcagtgactctgatctctacttcacacaaggggacaacagaataggaggaaaatactggaaggttcggtatactgaatttgttgatgcaacttttactaaaagaaagagactctctgctgaagaagcccatcttggaattcttggcccagtcatcaaggcagaggtgggtgataccctgttagtgacctttgccaacaaagccgacaaggtctatagcattttaccccatggtgtgatctatgacaaggcatctgatgcagccccaaacctagatggatttgtgaaaccaggggcgcatgttaaaccaggtgaaaccttcacatacaagtggacagtgcctgagagcgtaagcccaactgctggtgatcctccctgtctgacctatctttacttctcagcagttgatccaattaaggacaccagctctggcctggtagggcctttgctagtctgtaaaaagggcgtcctcaatgctgatgggacacagaaaggaatagacaaggagttttacctactgttcacagtctttgatgagaatctgagcagatattttgatgaaaacattcagaagtttatctggcatcccttcagcattgacaaagaagataaagagtttgtgaaatccaaccgaatgcatgctgttaacggctacatgtatggcaaccagccaggcttaaacatgtgtaaaagggatagagtttcctggcatctgattggattgggcactgacactgacatgcatggaattgtttttcaagggaacaccatccacctacgagggactcaccgagactccctggccctgtttccccacatggccacaacagcattcatgcagccagaccatgcaggtatttttagggtgttttgtgccaccatgccccacctctcgagaggcatgggtcagatctatgaggtcagcagctgtgacaacagggacccttctgagcagcggtacgggatgataagaactttttacatcgccgctgaagaagtagaatgggattatgcccctaacaaaaactgggagttcgaaaagcagcacgtggacgcaagaggggaaagacatggagatatatttatgaaccgcactgaaaattggattggctctcagtacaagaaggtggtttacagggaatatacggatggagaatttgtggagatcaaagcccgaccaccacgagaggagcacttagaactcctgggcccaatgattcatgctgaggtgggcaacaccgtcctgatcatatttaagaacaaagccagtaggccctactccatctcagcccagggtgtggaggagatggatagtggaaagcaattccaagtgcccatgacaaaaccaggagaagtaaaaacttatagatggaatatccctaaaagatccggtccagggccttctgatcccaattgtattccatgggtttactattcaacagtaaactttgtgaaggatacgtatagtggtttgatgggtcctctgattacatgccgaaaaggagtcttgaatgaaaagggaagaagaagtgacgttgattatgaatttgctctcttgtttttggtatttaatgagaatgaatcctggtatctggatgacaatattaagaagtatctcaacaaagatccacgagattttaagcgcactgatgattttgaggaaagcaacagaatgcatgccattaatggaaagatttttgggaatctccatggcctcataatgaacgaagatacaatgacaaactggtatttgttagggataggaagtgaagtggacatacataccatccattatcatgctgagagctttcttttcaaaatagataaatcttaccgagaagatgtgtatgatctctttcctgggacattccaaaccattgaactgtttgcagatcacccagggacatggctgctacactgtcatgtgtctgaccacatccatgctggcatggagacaacctacacggtccttcgtaacatagacaacaggattccttactccaccacatctcctggagtggcatctcacccagccacggtgccatctaacgaacgacctggcaaagagcagctctatttctttggcaagaatctgggtccaacaggagccaaggcagccttggtcatccttttcatcattggactcctccttctaatcaccacggtgattctctccctcagactctgctctgcaatgaagcagacagattaccagcaagtccagtcctgtgctctccccacggatgctctgtgaaccatctggtctccctcaacaggaaagggtgatgtcccacagctggccagatggcagccaacagggaaactggaccaaggcatcactcaccaaggaaggttgacactgtatcctggatcagccttctgatcctctcaaacatcatccaaagcaatttgcttttatttatttatttttaaatgggctgcgaataatcctcaggtataaaacacagaaaaaggagaatgggcatggctgagaatgtcaactcttagtctattctttggttggattcactgaataggagacactctgaaagatatctttatattccatcttttataattcttgaacagtgctttcttagctaaccaccaaagtttctaggtgaacagcttctagaaaaagttagagtgcctcagacatttaactggaagggcactactttttcaacattgttgcataacatgcatcccttggttctgtggaaaatatctttcttaggagttcttggcaatgtctaagtcagtgtctgctgatagaattagaccaaataaattttttggaggctttaaccagctctcctggccttttcctctttgatataaatagcctgtgcagtgcttgttttaaaaagcaaagttatacgttttttaaaaaattgctgctgtttttattcaaacctgtagaaatacttgaatgtttacaactcacttcatgttacatgtttttacaatatgtttctgtggcaatgtttgtactttcaaaaatcaagtagagaaattgtatttctactgcagactgtgggagggctgaaatctgtaaaagaacatgttaggctctccctttatgaatcagggactccctgagagtttagagcaagctttctatcagggagggaagctttgcaggaggcaagtctgggcttgaatttggagtctgatttttcattcagttagagggaatctttacaagtcctcatcttctatgaaattataacattctcattgtatgagaaacatcaggaggaatttatcaatgtaggtgactagataggagaagggacctctaaatatcctagattctatggcttttaaagacatacctcttcatggaaggagaaaaaaggaaaaggaaaggtgagaaaaagataatcttggtggcagattctcttaaaccattaaaccagctttgaaaattaataaataatttccaaggttcaaatgcaaaaaaattattgaacaactaaactcaacccattatgaggcaatctacactgtccatacctatgcttagacagtaggtgtaagattgataaaagtaacattgtttattacaagactgagaaattgcttttagctctgggcgagatgccctgagattccaatgccaatgctagatgagtgatactggtatgcctgccttagcagtgggtaatttgaatgtcaaagtgagtgacaaggacctaagaaatattctggtggagggacctttcacactgtctcatcttcatcttcatgaggggaaatgggtaattggatagaagctatagtcttaacataaaaggggatgcaaatgctaatagttctgttcatagtttgcttgaatgtcatatcaaacagcatacacaaaagattttgaatttcaatctgctaaccattgacaatgtgatttcatagtacatgttctacagttttcatacatgtgtaggctgcataatttcataattatggtaaatgccttatttattacccaccttagtaagacaagttgttcagttgtttttttttcttttcagtttatttttttaatgaaaacaaaaccacaaagtagtttgattgcatcatttatcattttaataaagtgtcacataaggtg

SEQ ID NO: 2781 - DNA, 2474 bp, Homo sapiens
aacaacaaaaccggcgcgccagcggtggcgcaacggctctcgtccccgccctcctgctacctgtagtcgcctgggccgcccccggcccagccctgccttgccgccaccctgcgctgtccagactgaggggtcaggcggagagccgggccgcgccttcggtcagcttctctccctttcacccgcgcctcctcgcgagacccggggctgggccgtgccggtcgccgcgcagcaggaagggagcggctgccacggaaaacgcctggccggacggtgtggctggcggccctgcctgggcgcggagggcggcggtggcgggccccgcggccttctctcagcttcctttctcctcacgacggcctccacagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccattgacgaaggatcagagattggtgtattcgggcagactgcttcccgatcatctgcagctgaaagacattctcagaaaacaagatgagtatcatatggttcatctagtatgtacttctcggactcctcccagttctccaaaatccagcaccaatagagaaagtcatgaagcattggcatccagcagcaattctagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtatcaagctgcagtttcagctcaggccacatcaaatgtcaacccaacccagcctactacttcacagcctctaaatttggcacatgttcctggagaagaacccccaccagctccaaacctagtggcccaagaaaatcgacccatgaatgagaatgttcaaatgaatgcacagggaggtccagtactaaatgaagaagacttcaatcgagactggctagactggatgtacacgttctcacgagctgcgattctccttagcattgtatacttctattcttcttttagtcggtttatcatggtaatgggagccatgctactggtttatttacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataactttcttttgatcatcatgtacagaggtgttttttttctttaggcttctcatgcatatgaatattttaagcacgaatggactactaaatatctgagttttttttttttttttttaaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagtgagctgagattgggccactgcactccaccctgggcgacagagtgagactcggtctcagaaaaaaaaaaaaaa

SEQ ID NO: 2782 - DNA, 3057 bp, Homo sapiens
aacaacaaaaccggcgcgccagcggtggcgcaacggctctcgtccccgccctcctgctacctgtagtcgcctgggccgcccccggcccagccctgccttgccgccaccctgcgctgtccagactgaggggtcaggcggagagccgggccgcgccttcggtcagcttctctccctttcacccgcgcctcctcgcgagacccggggctgggccgtgccggtcgccgcgcagcaggaagggagcggctgccacggaaaacgcctggccggacggtgtggctggcggccctgcctgggcgcggagggcggcggtggcgggccccgcggccttctctcaggtaccccagtgcccgctgaccgccctgagcggcccagctgcttccccgatccgcaccgcggggccgtggcgtaggggccttgttgcgttccagcttgggggtcgcggtggggcggggcagtgaccccgggccggccgttgtgccctcatccctcccacccttccttcgtatagcttcctttctcctcacgacggcctccacagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccattgacgaaggatcagagattggtgtattcgggcagactgcttcccgatcatctgcagctgaaagacattctcagaaaacaagatgagtatcatatggttcatctagtatgtacttctcggactcctcccagttctccaaaatccagcaccaatagagaaagtcatgaagcattggcatccagcagcaattctagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtatcaagctgcagtttcagctcaggccacatcaaatgtcaacccaacccagcctactacttcacagcctctaaatttggcacatgttcctggagaagaacccccaccagctccaaacctagtggcccaagaaaatcgacccatgaatgagaatgttcaaatgaatgcacagggaggtccagtactaaatgaagaagacttcaatcgagactggctagactggatgtacacgttctcacgagctgcgattctccttagcattgtatacttctattcttcttttagtcggtttatcatggtaatgggagccatgctactggtttatttacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataactttcttttgatcatcatgtacagaggtgttttttttctttaggcttctcatgcatatgaatattttaagcacgaatggactactaaatatctgagttttttttttttttttttaaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagtgagctgagattgggccactgcactccaccctgggcgacagagtgagactcggtctcagaaaaaaaaaaaaaagagctgcttcacatataaatgtctatagctagtagcctggccctttaatgtttaatttgaatagatatatctgttttccgtgaattatcttgaaagttttaaacagaatgacctcatagtttttaataaagaatattatttacctaaaatgtgctagtagcatcttgcccagccataaagcaataaacttctcaataatcttaattttgatatttgaataaataatggaaactttctgtattaagggcatgtatcccatcaattggaatcagtaccttaacagaaaaaggcagctcttcaatggaattaacgtgatataaaatgtttgatataggcagtacttttataaaaaaagataagctggaaattgctccgtgtaattttttaaataaaaagtcaattatggtaaa

SEQ ID NO: 2783 - DNA, 2666 bp, Homo sapiens
agttctcttcaagtcatgtaatcgacttttttgaattagttttcagtttcattttgttttccctaattcaagttgggaacacttcattttccccaattcaagttgggaacacttccttggtatttccttgctacatggactttagcaaatgctactttactctccttccagctactcaggaggctgaggcaggagaatcgcttgaacccgggaggcggaggttacagtgagccttttcctagttttactgttggaagcctaactcacaggagagattatgcaatacagtcctgaagtcaagggaggagagcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacacaaa

SEQ ID NO: 2784 - DNA, 585 bp, Homo sapiens
ttcttatggactacttagcatttgactagacggtatgaatttctaagtaagctactcaggaggctgaggcaggagaatcgcttgaacccgggaggcggaggttacagtgagccttttcctagttttactgttggaagcctaactcacaggagagattatgcaatacagtcctgaagtcaagggaggagagcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataat

SEQ ID NO: 2785 - DNA, 594 bp, Homo sapiens
gtttattcttatggactacttagcatttgactagacggtatgaatttctaagtaagcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgt

SEQ ID NO: 2786 - DNA, 2379 bp, Homo sapiens
atttctcatctcagcacatatagaactggatgcccttgtggtacatctcaaggctgatttgaaagcttgagagaccatcaagaattggatttggggaagagcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacacaaa

SEQ ID NO: 2787 - DNA, 573 bp, Homo sapiens
attcttatggactacttagcatttgactagacggtatgaatttctaagtaagcacatatagaactggatgcccttgtggtacatctcaaggctgatttgaaagcttgagagaccatcaagaattggatttggggaagagcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgcta

SEQ ID NO: 2788 - DNA, 2406 bp, Homo sapiens
agtttactctacatcatagcagagaaaatggacaaaacacagctgttttgcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacacaaa

SEQ ID NO: 2789 - DNA, 2572 bp, Homo sapiens
cgcgccgggaacagccagtcggtgcctaacgcgagtgtatctcgagagagaagcgatcaacagctgccggtctgcgcctgcgcgcggcgggggcgtggcccggggcgagtggggccaaggaggcagccgggagcggcgggcgcaggtgttactggttgcgtcgggtcacgtgggcgcgcaggcgcagcgcggtgcagcccgttcgctcacacaaagcccagacgcggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccctgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggcgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactg

SEQ ID NO: 2790 - DNA, 2455 bp, Homo sapiens
cgcgccgggaacagccagtcggtgcctaacgcgagtgtatctcgagagagaagcgatcaacagctgccggtctgcgcctgcgcgcggcgggggcgtggcccggggcgagtggggccaaggaggcagccgggagcggcgggcgcaggtgttactggttgcgtcgggtcacgtgggcgcgcaggcgcagcgcggtgcagcccgttcgctcacacaaagcccagacgcggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccctgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggcgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactg

SEQ ID NO: 2791 - DNA, 2455 bp, Homo sapiens
cgcgccgggaacagccagtcggtgcctaacgcgagtgtatctcgagagagaagcgatcaacagctgccggtctgcgcctgcgcgcggcgggggcgtggcccggggcgagtggggccaaggaggcagccgggagcggcgggcgcaggtgttactggttgcgtcgggtcacgtgggcgcgcaggcgcagcgcggtgcagcccgttcgctcacacaaagcccagacgcggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaagggtaagtgttgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccctgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggcgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactg

SEQ ID NO: 2792 - DNA, 2474 bp, Homo sapiens
cgcgccgggaacagccagtcggtgcctaacgcgagtgtatctcgagagagaagcgatcaacagctgccggtctgcgcctgcgcgcggcgggggcgtggcccggggcgagtggggccaaggaggcagccgggagcggcgggcgcaggtgttactggttgcgtcgggtcacgtgggcgcgcaggcgcagcgcggtgcagcccgttcgctcacacaaagcccagacgcggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccctgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggcgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactg

SEQ ID NO: 2793 - DNA, 3689 bp, Homo sapiens
atttagtccgcaacacctcgctccccaggaggtctgccagcctggactggaagcgtgcaacactccagagtcgtaggagtgaacactgcacaggaatctctgcccatctcaggagaaaccaaacttggggaaaatgtttgcggtccacttgatggcattttacttcagcaagctgaaggaggaccagatcaagaaggtggacaggttcctgtatcacatgcggctctccgatgacacccttttggacatcatgaggcggttccgggctgagatggagaagggcctggcaaaggacaccaaccccacggctgcagtgaagatgttgcccaccttcgtcagggccattcccgatggttccgaaaatggggagttcctttccctggatctcggagggtccaagttccgagtgctgaaggtgcaagtcgctgaagaggggaagcgacacgtgcagatggagagtcagttctacccaacgcccaatgaaatcatccgcgggaacggcacagagctgtttgaatatgtagctgactgtctggcagatttcatgaagaccaaagatttaaagcataagaaattgccccttggcctaactttttctttcccctgtcgacagactaaactggaagagggtgtcctactttcgtggacaaaaaagtttaaggcacgaggagttcaggacacggatgtggtgagccgtctgaccaaagccatgagaagacacaaggacatggacgtggacatcctggccctggtcaatgacaccgtggggaccatgatgacctgtgcctatgacgacccctactgcgaagttggtgtcatcatcggaactggcaccaatgcgtgttacatggaggacatgagcaacattgacctggtggagggcgacgagggcaggatgtgcatcaacacagagtggggggccttcggggacgacggggccctggaggacattcgcactgagttcgacagggagctggacctcggctctctcaacccaggaaagcaactgttcgagaagatgatcagtggcctgtacctgggggagcttgtcaggcttatcttgctgaagatggccaaggctggcctcctgtttggtggtgagaaatcttctgctctccacactaagggcaagatcgaaacacggcacgtggctgccatggagaagtataaagaaggccttgctaatacaagagagatcctggtggacctgggtctggaaccgtctgaggctgactgcattgccgtccagcatgtctgtaccatcgtctccttccgctcggccaatctctgtgcagcagctctggcggccatcctgacacgcctccgggagaacaagaaggtggaacggctccggaccacagtgggcatggacggcaccctctacaagatacaccctcagtacccaaaacgcctgcacaaggtggtgaggaaactggtcccaagctgtgatgtccgcttcctcctgtcagagagtggcagcaccaagggggccgccatggtgaccgcggtggcctcccgcgtgcaggcccagcggaagcagatcgacagggtgctggctttgttccagctgacccgagagcagctcgtggacgtgcaggccaagatgcgggctgagctggagtatgggctgaagaagaagagccacgggctggccacggtcaggatgctgcccacctacgtctgcgggctgccggacggcacagagaaaggaaagtttctcgccctggatcttgggggaaccaacttccgggtcctcctggtgaagatcagaagtggacggaggtcagtgcgaatgtacaacaagatcttcgccatccccctggagatcatgcagggcactggtgaggagctctttgatcacattgtgcagtgcatcgccgacttcctggactacatgggcctcaagggagcctccctacctttgggcttcacattctcatttccctgcaggcagatgagcattgacaagggaacactcatagggtggaccaaaggtttcaaggccactgactgtgaaggggaggacgtggtggacatgctcagggaagccatcaagaggagaaacgagtttgacctggacattgttgcagtcgtgaatgatacagtggggaccatgatgacctgtggctatgaagatcctaattgtgagattggcctgattgcaggaacaggcagcaacatgtgctacatggaggacatgaggaacatcgagatggtggaggggggtgaagggaagatgtgcatcaatacagagtggggaggatttggagacaatggctgcatagatgacatctggacccgatacgacacggaggtggatgaggggtccttgaatcctggcaagcagagatacgagaaaatgaccagtgggatgtacttgggggagattgtgcggcagatcctgatcgacctgaccaagcagggtctcctcttccgagggcagatttcagagcgtctccggaccaggggcatcttcgaaaccaagttcctgtcccagatcgaaagcgatcggctggcccttctccaggtcaggaggattctgcagcagctgggcctggacagcacgtgtgaggacagcatcgtggtgaaggaggtgtgcggagccgtgtcccggcgggcggcccagctctgcggtgctggcctggccgctatagtggaaaaaaggagagaagaccaggggctagagcacctgaggatcactgtgggtgtggacggcaccctgtacaagctgcaccctcacttttctagaatattgcaggaaactgtgaaggaactagcccctcgatgtgatgtgacattcatgctgtcagaagatggcagtggaaaaggggcagcactgatcactgctgtggccaagaggttacagcaggcacagaaggagaactaggaacccctgggattggacctgatgcatcttggatactgaacagcttttcctctggcagatcagttggtcagagaccaatgggcaccctcctggctgacctcaccttctggatggccgaaagagaaccccaggttctcgggtactcttagtatcttgtactggatttgcagtgacattacatgacatctctatttggtatatttgggccaaaatgggccaacttatgaaatcaaagtgtctgtcctgagagatcccctttcaacacattgttcaggtgaggcttgagctgtcaattctctatggctttcagtcttgtggctgcgggacttggaaatatatagaatctgcccatgtggctggcaggctgtttccccattgggatgcttaagccatctcttataggggattggaccctgtacttgtggatgaacattggagagcaagaggaactcacgttatgaactagggggatctcatctaacttgtccttaacttgccatgttgacttcaaacctattaagagaacaaagactttgaagtatccagccccagggtgcagagaggttgattgccagggagcactgcaggaatcattgcatgcttaaagcgagttatgtcagcaccctgtaggattttgttccttattaagtgtgtgccatgtggtggggtgctgtctggggcatctgtttttcattttgcctgtggtttgtgttgcaggtgttgatagttgttttaaggattgttaggtataggaaatccagtaaattaataaaaaaattttgattttccaataaactttgca

SEQ ID NO: 2794 - DNA, 2554 bp, Homo sapiens
atttagtccgcaacacctcgctccccaggaggtctgccagcctggactggaagcgtgcaacactccagagtcgtaggagtgaacactgcacaggaatctctgcccatctcaggagaaaccaaacttggggaaaatgtttgcggtccacttgatggcattttacttcagcaagctgaaggaggaccagatcaagaaggtggacaggttcctgtatcacatgcggctctccgatgacacccttttggacatcatgaggcggttccgggctgagatggagaagggcctggcaaaggacaccaaccccacggctgcagtgaagatgttgcccaccttcgtcagggccattcccgatggttccgaaaatggggagttcctttccctggatctcggagggtccaagttccgagtgctgaaggtgcaagtcgctgaagaggggaagcgacacgtgcagatggagagtcagttctacccaacgcccaatgaaatcatccgcgggaacggcacagagctgtttgaatatgtagctgactgtctggcagatttcatgaagaccaaagatttaaagcataagaaattgccccttggcctaactttttctttcccctgtcgacagactaaactggaagagggtgtcctactttcgtggacaaaaaagtttaaggcacgaggagttcaggacacggatgtggtgagccgtctgaccaaagccatgagaagacacaaggacatggacgtggacatcctggccctggtcaatgacaccgtggggaccatgatgacctgtgcctatgacgacccctactgcgaagttggtgtcatcatcggaactggcaccaatgcgtgttacatggaggacatgagcaacattgacctggtggagggcgacgagggcaggatgtgcatcaacacagagtggggggccttcggggacgacggggccctggaggacattcgcactgagttcgacagggagctggacctcggctctctcaacccaggaaagcaactgttcgagaagatgatcagtggcctgtacctgggggagcttgtcaggcttatcttgctgaagatggccaaggctggcctcctgtttggtggtgagaaatcttctgctctccacactaagggcaagatcgaaacacggcacgtggctgccatggagaagtataaagaaggccttgctaatacaagagagatcctggtggacctgggtctggaaccgtctgaggctgactgcattgccgtccagcatgtctgtaccatcgtctccttccgctcggccaatctctgtgcagcagctctggcggccatcctgacacgcctccgggagaacaagaaggtggaacggctccggaccacagtgggcatggacggcaccctctacaagatacaccctcagtacccaaaacgcctgcacaaggtggtgaggaaactggtcccaagctgtgatgtccgcttcctcctgtcagagagtggcagcaccaagggggccgccatggtgaccgcggtggcctcccgcgtgcaggcccagcggaagcagatcgacagggtgctggctttgttccagctgacccgagagcagctcgtggacgtgcaggccaagatgcgggctgagctggagtatgggctgaagaagaagagccacgggctggccacggtcaggatgctgcccacctacgtctgcgggctgccggacggcacagagaaaggaaagtttctcgccctggatcttgggggaaccaacttccgggtcctcctggtgaagatcagaagtggacggaggtcagtgcgaatgtacaacaagatcttcgccatccccctggagatcatgcagggcactggtgaggagctctttgatcacattgtgcagtgcatcgccgacttcctggactacatgggcctcaagggagcctccctacctttgggcttcacattctcatttccctgcaggcagatgagcattgacaagggaacactcatagggtggaccaaaggtttcaaggccactgactgtgaaggggaggacgtggtggacatgctcagggaagccatcaagaggagaaacgagtttgacctggacattgttgcagtcgtgaatgatacagtggggaccatgatgacctgtggctatgaagatcctaattgtgagattggcctgattgcaggaacaggcagcaacatgtgctacatggaggacatgaggaacatcgagatggtggaggggggtgaagggaagatgtgcatcaatacagagtggggaggatttggagacaatggctgcatagatgacatctggacccgatacgacacggaggtggatgaggggtccttgaatcctggcaagcagagatacgagaaaatgaccagtgggatgtacttgggggagattgtgcggcagatcctgatcgacctgaccaagcagggtctcctcttccgagggcagatttcagagcgtctccggaccaggggcatcttcgaaaccaagttcctgtcccagatcgaaaggatgttatcagtcattgatgcatattgcctggatctattatttcactag

SEQ ID NO: 2795 - DNA, 2344 bp, Homo sapiens
atttagtccgcaacacctcgctccccaggaggtctgccagcctggactggaagcgtgcaacactccagagtcgtaggagtgaacactgcacaggaatctctgcccatctcaggagaaaccaaacttggggaaaatgtttgcggtccacttgatggcattttacttcagcaagctgaaggaggaccagatcaagaaggtggacaggttcctgtatcacatgcggctctccgatgacacccttttggacatcatgaggcggttccgggctgagatggagaagggcctggcaaaggacaccaaccccacggctgcagtgaagatgttgcccaccttcgtcagggccattcccgatggttccgaaaatggggagttcctttccctggatctcggagggtccaagttccgagtgctgaaggtgcaagtcgctgaagaggggaagcgacacgtgcagatggagagtcagttctacccaacgcccaatgaaatcatccgcgggaacggcacagagctgtttgaatatgtagctgactgtctggcagatttcatgaagaccaaagatttaaagcataagaaattgccccttggcctaactttttctttcccctgtcgacagactaaactggaagagggtgtcctactttcgtggacaaaaaagtttaaggcacgaggagttcaggacacggatgtggtgagccgtctgaccaaagccatgagaagacacaaggacatggacgtggacatcctggccctggtcaatgacaccgtggggaccatgatgacctgtgcctatgacgacccctactgcgaagttggtgtcatcatcggaactggcaccaatgcgtgttacatggaggacatgagcaacattgacctggtggagggcgacgagggcaggatgtgcatcaacacagagtggggggccttcggggacgacggggccctggaggacattcgcactgagttcgacagggagctggacctcggctctctcaacccaggaaagcaactgttcgagaagatgatcagtggcctgtacctgggggagcttgtcaggcttatcttgctgaagatggccaaggctggcctcctgtttggtggtgagaaatcttctgctctccacactaagggcaagatcgaaacacggcacgtggctgccatggagaagtataaagaaggccttgctaatacaagagagatcctggtggacctgggtctggaaccgtctgaggctgactgcattgccgtccagcatgtctgtaccatcgtctccttccgctcggccaatctctgtgcagcagctctggcggccatcctgacacgcctccgggagaacaagaaggtggaacggctccggaccacagtgggcatggacggcaccctctacaagatacaccctcagtacccaaaacgcctgcacaaggtggtgaggaaactggtcccaagctgtgatgtccgcttcctcctgtcagagagtggcagcaccaagggggccgccatggtgaccgcggtggcctcccgcgtgcaggcccagcggaagcagatcgacagggtgctggctttgttccagctgacccgagagcagctcgtggacgtgcaggccaagatgcgggctgagctggagtatgggctgaagaagaagagccacgggctggccacggtcaggatgctgcccacctacgtctgcgggctgccggacggcacagagaaaggaaagtttctcgccctggatcttgggggaaccaacttccgggtcctcctggtgaagatcagaagtggacggaggtcagtgcgaatgtacaacaagatcttcgccatccccctggagatcatgcagggcactggtgaggagctctttgatcacattgtgcagtgcatcgccgacttcctggactacatgggcctcaagggagcctccctacctttgggcttcacattctcatttccctgcaggcagatgagcattgacaagggaacactcatagggtggaccaaaggtttcaaggccactgactgtgaaggggaggacgtggtggacatgctcagggaagccatcaagaggagaaacgagtttgacctggacattgttgcagtcgtgaatgatacagtggggaccatgatgacctgtggctatgaagatcctaattgtgagattggcctgattgcaggaacaggcagcaacatgtgctacatggaggacatgaggaacatcgagatggtggaggggggtgaagggaagatgtgcatctgtttttcattttgcctgtggtttgtgttgcaggtgttgatagttgttttaaggattgttaggtataggaaatccagtaaattaataaaaaaattttga

SEQ ID NO: 2796 - DNA, 1373 bp, Homo sapiens
ggctgggacggctgtgggtggggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataatttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatgtcaaa

SEQ ID NO: 2797 - DNA, 1322 bp, Homo sapiens
gcgcctgcagggatcggaagccggttggggtgtgagaggttttctcgctctagaacctcatagaaattctttctcagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataatttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatg

SEQ ID NO: 2798 - DNA, 585 bp, Homo sapiens
aagcgaaacaagccgggggactgcgagccagggactcgggccgcggggcgggaagaagtggggcagcgcttggccaggccgaaaggactttgggggtgggggctgggagtccgtgtctcgaatgagggaggagaggtggagttgccggggctcaggcccggcctcgagcatgggcggatgagaggagtcgggagccgaggcctagggtccttcgggtgaggggagacggagccagcgaggagatggagcagaagcttgtggaggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttg

SEQ ID NO: 2799 - DNA, 618 bp, Homo sapiens
gcagatggtaggaaatggagacggagaaatggcactaatggcccagccacctgagatgggatacctgggagggacatcttttcaagtagaggctgtgttggggcatggtgagagagggtcttagcaggtaaccttcctttcctctccagactgaggaatcagagttctgattgtggagtgcctctctctaggacggggctgcagcataggagtctcagctgcttacatccaggtccaggattatgtctgctaacagacgctggtgggtaccacctgacgacgaagactgtgtgtctgagaagctcctgaggaagactcgggaatctccactggtgcctataggcttaggaggctgcttggtggtagcagcatacaggatttaccggctgaggtctcgtggttccaccaagatgtccatacacctgattcacacccgagtggcagcgcaggcctgtgcagtgggtgcaatcatgctaggtgctgtgtacacaatgtacagcgattacgtcaagaggatggcacaggatgctggagagaagtaggactcctataggagccggggctgtccaactcccctaactcaatccctggtacattcctaataaagcagttttgagg

SEQ ID NO: 2800 - DNA, 668 bp, Homo sapiens
ccgcccctttcatgaccttcaccgggaggctgaggtcggagtcccgattttctcctgctgctgtggcccggacatggcgactcccggccctgtgattccggaggtcccctttgaaccatcgaagcctccagtcattgaggggctgagccccactgtttacaggaatccagagagtttcaaggaaaagttcgttcgcaagacccgcgagaacccggtggtacccataggttgcctggccacggcggccgccctcacctacggcctctactccttccaccggggcaacagccagcgctctcagctcatgatgcgcacccggatcgccgcccagggtttcacggtcgcagccatcttgctgggtctggctgtcactgctatgaagtctcgaccctaagcccagggtctggccttgaaagctccgcagaaatgattccaaaacccagggagcaaccactggccctaccgtgggacttactccctcctctcctttgagaggcccatgtgtcgctggggaggaagtgaccctttgtgtaactgtaaccgaaagttttttcaaaaatcctagatgctgttgtttgaatgttacatacttctatttgtgccacatctcccctccactcccctgcttaataaactctaaaaatccacttgtatttaattcagtatca

SEQ ID NO: 2801 - DNA, 1085 bp, Homo sapiens
ggaggactgtgaggaagcgggggaaggaagtaaatcgccgagtgacctaaggaatcagggggaggattagggtctgctccacagaaggcttacctctgaaagagtcggggagggaatgcgcagccactcgctgcctttatcccgagaagcccctaacacccctcgccgtggtctgtacatggtctgtacctccggccgcgctggctggtaggccagccacctgggatggcagcctagttctcccgccaccttaccctgccctgactctaatctgcatttaattcagtccttcttccgggagatttcggcggagaatttctttctcgccttagctactgaggtcaaacctgaaataggctgtagactccaccagctgggtaagaatgggaagaagatcagaaaacctaaactttggttgatggactattttgcccaggcaaaagcagggaatctatgaggaatatgaagacattcgtcgggagaactctgttggcactttccactgttccatctgtggcctaggcatggcgactctcggctttgtgactccggaggccccctttgaatcatcgaagccccccatctttgaggggcttagccccactgtttacagcaatccagagggtttcaaggaaaagttccttcgcaagacccgcgagaatccggtggtacccataggtttcctgtgcacggcggccgtcctcaccaacggcctctactgcttccaccagggcaacagccaatgttcacggcttatgatgcacacccagatcgccgcccagggcttcaccattgcagccatcttgctgggtctagctgccaccgctatgaagtctccaccctgagcccagggtcttgaaaactctgcagaaatcattccaaaacccaggagcaaccactggccctaccatgggacttactctctcctctcctttgagaggtccctgtgtcgttgggggaggaagtgacccttcctgtaaccataactgaaagattttttcaaaaatcccagattctgttgtttgaatgttacatatttctatttgtgccacatcttccctccactcccctgcttaataaactct

SEQ ID NO: 2802 - DNA, 2777 bp, Homo sapiens
aggcaggccgggccctcaagatggcggcgggcgcccagagcggctcggcccggcagtagtggtgggacggcactagctgctggggcctgccgccccgggagtggctgcagcagcgccaggaatcgaggatggtaaaatgacccaggggaagaagaagaaacgggccgcgaaccgcagtatcatgctggccaagaagatcatcattaaggacggaggcacgcctcaaggaataggttctcctagtgtctatcatgcagttatcgtcatctttttggagttttttgcttggggactattgacagcacccaccttggtggtattacatgaaacctttcctaaacatacatttctgatgaacggcttaattcaaggagtaaagggtttgttgtcattccttagtgccccgcttattggtgctctttctgatgtttggggccgaaaatccttcttgctgctaacggtgtttttcacatgtgccccaattcctttaatgaagatcagcccatggtggtactttgctgttatctctgtttctggggtttttgcagtgactttttctgtggtatttgcatacgtagcagatataacccaagagcatgaaagaagtatggcttatggactggtttcagcaacatttgctgcaagtttagtcaccagtcctgcaattggagcttatcttggacgagtatatggggacagcttggtggtggtcttagctacagcaatagctttgctagatatttgttttatccttgttgctgtgccagagtcgttgcctgagaaaatgcggccagcatcctggggagcacccatttcctgggaacaagctgacccttttgcgtccttaaaaaaagtcggccaagattccatagtgctgctgatctgcattacagtgtttctctcctacctaccggaggcaggccaatattccagcttttttttatacctcagacagataatgaaattttcaccagaaagtgttgcagcgtttatagcagtccttggcattctttccattattgcacagaccatagtcttgagtttacttatgaggtcaattggaaataagaacaccattttactgggtctaggatttcaaatattacagttggcatggtatggctttggttcagaaccttggatgatgtgggctgctggggcagtagcagccatgtctagcatcacctttcctgctgtcagtgcacttgtttcacgaactgctgatgctgatcaacagggtgtcgttcaaggaatgataacaggaattcgaggattatgcaatggtctgggaccggccctctatggattcattttctacatattccatgtggaacttaaagaactgccaataacaggaacagacttgggaacaaacacaagccctcagcaccactttgaacagaattccatcatccctggccctcccttcctatttggagcctgttcagtactgctggctctgcttgttgccttgtttattccggaacataccaatttaagcttaaggtccagcagttggagaaagcactgtggcagtcacagccatcctcataatacacaagcgccaggagaggccaaagaacctttactccaggacacaaatgtgtgacgactgaaatcaggaagatttttctatcagcacccaggtcttagttttcacctctagttctggatgtacattccatttccatccacagtgtactttaagattgtcttaagaaatgtatctgcatgaactccgtgggaactaaaggaagtgggaacttagaaccagacagttttccaaagatgttacaatttcttttgaaaaaccttttgtttattagcaccaatttcttgccactaagctatttgttttattatacatcctttaattaaaaactatatatgtaacttcttagatattagcaaatgtctctgctaccatttccttaaggtgttgagctttaactctatgctgactcagtgagacacagtaggtagtatggttgtggacctatttgttttaacattgtaaaattttgagtcagattttaatattgtaaaatcttgggtcaaataattcaaagccttaatgcagatgcactaaaacaaagaaatggtaaatgaattgtttgcatttaaaaaaaaaaactcttaagaaaactgtactaaatctgaatcatgttttgagcttgtttgcagtacttttaaacattattcactactgtttttgaagtgagaaagtatcagccatttagcatttaagttggggtatttagagcctgtaatctaaatgctggctcaaatttattccccagctacttcttataccactattcttttaatgtttgcataatcataagcacctcaacacttgaatacataatctaaaaattatatagtaaagctggtagccttgaaaatgtcagtgtgatatctattatgtagataaatatatatagtggcctttcaggactgtcacagtaacactttatttacagagctaatgtttgtcctaaattttcaggaccctagaggagagctttatacaattaccgatgtgaatttctctaaagtgtatatttttgtgtccagttatattatttaaaaaagtgttactttgtaaaaattgtatataaagaactgtatagtttacactgttttcatcttgtgtgtggttattgcttaatgctttttaaacttggaacactcactatggttaaataaggtcttaaaagaaatgtaaatattctgttaataaagttaaatattttaatgattttttttttaaaaaa

SEQ ID NO: 2803 - DNA, 467 bp, Homo sapiens
acatgaaacctttcctaaacatacatttctgatgaacggcttaattcaaggagtaaagggtttgttgtcattccttagtgccccgcttattggtgctctttctgatgtttggggccgaaaatccttcttgctgctaacggtgtttttcacatgtgccccaattcctttaatgaagatcagcccatggtggtactttgctgttatctctgtttctggggtttttgcagtgactttttctgtggtatttgcatacgtagcagatataacccaagagcatgaaagaagtatggcttatggactggtatgtatgtttattctataccttttgtatctgctgagaaatgccttgtttttaagataaatattattataaggagtgcaaacctttgcattacaagatttttgcgtaaaatatattttgtaataaaatcattcattagactacatttaaaatttttttgcggtat

SEQ ID NO: 2804 - DNA, 1616 bp, Homo sapiens
cccgcccctgacgccgccggtaactgcgagagtcggggtcggtgcggtttgataagtggtcggttcctggagctgcggtcttctgctagcctgatccgcagcttcagcctccgccgcctcctcagccctcggcgccgccgctggcgccgccgcctgacccgcaggccgccgcgggccgcagagcccatgagggcgcgggcaccgccgccgcctccgcggcgtcgccgtcgtcccggagcgccccgggctggcgcgggcatggccgcggcatgagcgtggagccgccgccggagctggaggagaaggcggcgtcggagcccgaggcgggagccatgccggagaagcgcgcgggcgcgcaggccgcggggagcacctggctacaaggctttggccgaccaagtgtgtaccatgctgctattgtcatcttccttgaattctttgcgtggggcctgttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatggtggtattttgcgatgatttctgtgtctggagtcttctcggtcacgttttctgttatatttgcctatgtagctgatgtcactcaggagcacgagcgaagtacagcttatggatgggtctcagccacctttgcggctagtcttgtcagcagcccggccattggagcatatctttctgccagttacggagacagcctcgttgtgctggtggccacagtggtggctcttctggacatctgcttcatcttagtggctgttccagaatctctgcctgagaaaatgagaccggtttcctggggagctcagatttcttggaaacaagcagacccttttgcgtcgttgaagaaagttggaaaagattctactgtcttactaatctgcatcaccgtgtttctttcataccttcctgaagctggacagtattcaagtttttttctctatctcaggcaggtcataggttttggatctgttaaaattgcagcattcatagctatggtaggaattctgtctattgtggctcagacggcctttcttagcatcttgatgagatcattaggaaataagaatactgtcctccttggcttgggcttccagatgctccagttagcctggtacggttttggatcacaggcctggatgatgtgggcagcagggaccgtggctgccatgtccagcatcacgtttccggcaatcagtgccctcgtctctcggaatgcagagtcagatcagcaaggagttgcccaggatcataactggaataagaggactatgcaatggcctggggccctgtatggcttcatattctacatgttccatgtggaactgactgagttgggcccgaaattgaattctaacaacgttcccctgcaggggagctgtcatcccaggcccgccgtttttatttggggcatgtatagtccttatgtcttttctggttgccttattcattcctga

SEQ ID NO: 2805 - DNA, 3420 bp, Homo sapiens
cccgcccctgacgccgccggtaactgcgagagtcggggtcggtgcggtttgataagtggtcggttcctggagctgcggtcttctgctagcctgatccgcagcttcagcctccgccgcctcctcagccctcggcgccgccgctggcgccgccgcctgacccgcaggccgccgcgggccgcagagcccatgagggcgcgggcaccgccgccgcctccgcggcgtcgccgtcgtcccggagcgccccgggctggcgcgggcatggccgcggcatgagcgtggagccgccgccggagctggaggagaaggcggcgtcggagcccgaggcgggagccatgccggagaagcgcgcgggcgcgcaggccgcggggagcacctggctacaaggctttggccgaccaagtgtgtaccatgctgctattgtcatcttccttgaattctttgcgtggggcctgttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatggtggtattttgcgatgatttctgtgtctggagtcttctcggtcacgttttctgttatatttgcctatgtagctgatgtcactcaggagcacgagcgaagtacagcttatggatgggtctcagccacctttgcggctagtcttgtcagcagcccggccattggagcatatctttctgccagttacggagacagcctcgttgtgctggtggccacagtggtggctcttctggacatctgcttcatcttagtggctgttccagaatctctgcctgagaaaatgagaccggtttcctggggagctcagatttcttggaaacaagcagacccttttgcgtcgttgaagaaagttggaaaagattctactgtcttactaatctgcatcaccgtgtttctttcataccttcctgaagctggacagtattcaagtttttttctctatctcaggcaggtcataggttttggatctgttaaaattgcagcattcatagctatggtaggaattctgtctattgtggctcagacggcctttcttagcatcttgatgagatcattaggaaataagaatactgtcctccttggcttgggcttccagatgctccagttagcctggtacggttttggatcacaggcctggatgatgtgggcagcagggaccgtggctgccatgtccagcatcacgtttccggcaatcagtgccctcgtctctcggaatgcagagtcagatcagcaaggagttgcccaggggatcataactggaataagaggactatgcaatggcctggggccagcactgtatggcttcatattctacatgttccatgtggaactgactgagttgggcccgaaattgaattctaacaacgttcccctgcagggagctgtcatcccaggcccgccgtttttatttggggcatgtatagtccttatgtcttttctggttgccttattcattcctgaatacagtaaagccagtggagttcaaaaacacagtaacagcagcagcggcagcctgaccaacaccccagaacggggcagtgatgaggacattgagccactactgcaagacagcagcatctgggagctctcttcatttgaggagcctgggaatcagtgcactgagctgtaaactcggcagaaagtgggattctgcatacgccatctctgagagccatggagggagccacacccctggtgacttcatggtgctggatgggagacgctagcggcatccttcagggccaagtttgataaataccaccgccatcattctgctcatcctcctcctgttttttttttttctcttacattctttttttttttcctgtttatacattagaacaagataagatttgaaatacttccttgcaaataatgtgcaactcccaaggtgaaactcaaatagaaaaagtcatctctctggtagaaaggatggctttcctgtaatgactatagagtaagagtggcagcaatctttccatgcccttttcagcagaaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaactttacagatttatatgtattttgctgcaccagtaaatggaccattaactagggcccacctttaacagagcacccctttgaaagttttataggtatgaaatatatgtagatatttgtaaagggttttaattttttttttttgatggggtgctgtgtaaatcttgtatttataaatgtaatgaaggtattgacagaaaaaaatatatacaacttttataaaggattgtgtactgactgaatacatttaaaagaaaatatattttgaaacctgttctgctatgaacagagataacatatctttttactatgctattggtttttaggttaagcttcctaatgcataataaatttacagtggttacttttatgtcttgtgtcttttttttaaagcaaatagtattgctcttttgggttctctgttgggtggctttcaattaaactgagttgtaatctttcagctgatgcaaaaggtatgtattttcaaaaaaa

SEQ ID NO: 2806 - DNA, 1373 bp, Homo sapiens
cttgaattctttgcgtggggcctgttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatggtggtattttgcgatgatttctgtgtctggagtcttctcggtcacgttttctgttatatttgcctatgtagctgatgtcactcaggagcacgagcgaagtacagcttatggatgggtctcagccacctttgcggctagtcttgtcagcagcccggccattggagcatatctttctgccagttacggagacagcctcgttgtgctggtggccacagtggtggctcttctggacatctgcttcatcttagtggctgttccagaatctctgcctgagaaaatgagaccggtttcctggggagctcagatttcttggaaacaagcagacccttttgcgtcgttgaagaaagttggaaaagattctactgtcttactaatctgcatcaccgtgtttctttcataccttcctgaagctggacagtattcaagtttttttctctatctcaggcaggtcataggttttggatctgttaaaattgcagcattcatagctatggtaggaattctgtctattgtggctcagacggcctttcttagcatcttgatgagatcattaggaaataagaatactgtcctccttggcttgggcttccagatgctccagttagcctggtacggttttggatcacaggcctggagttgcccaggggatcataactggaataagaggactatgcaatggcctggggccagcactgtatggcttcatattctacatgttccatgtggaactgactgagttgggcccgaaattgaattctaacaacgttcccctgcagggagctgtcatcccaggcccgccgtttttatttggggcatgtatagtccttatgtcttttctggttgccttattcattcctgaatacagtaaagccagtggagttcaaaaacacagtaacagcagcagcggcagcctgaccaacaccccagaacggggcagtgatgaggacattgagccactactgcaagacagcagcatctgggagctctcttcatttgaggagcctgggaatcagtgcactgagctgtaaactcggcagaaagtgggattctgcatacgccatctctgagagccatggagggagccacacccctggtgacttcatggtgctggatgggagacgctagcggcatccttca

SEQ ID NO: 2807 - DNA, 779 bp, Homo sapiens
gcggtttgctaagtggtcggttcctggagctgcggtcttctgctagcctgatccgcagcttcagcctccgccgcctcctcagccctcggcgccgccgcctgacccgcaggccgccgcgggccgcagagcccatgagggcgcgggcaccgccgccgcctccgcggcgtcgccgtcgtcccggagcgccccgagctggcgcgggcatggccgcggcatgagcgtggagccgccgccggagctggaggagaaggcggcgtcggagcccgaggcgggagccatgccggagaagcgcgcgggcgcgcaggccgcggggagcacctggctacaaggctttggcccaccaagtgtgtaccatgctgctattgtcatcttccttgaattctttgcgtggggccttttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatgccaggcgtgatggtccacatctgtaatcccagctactcgggagtccgaggcaggagaattgcttgaaccagggaggcggaggttgcagtgagctcaggtcgtgccattgcactccagcctgggcaacaagagtgaaactccgtctccaaaaaaaaagaaaaaaaaagggg

SEQ ID NO: 2808 - DNA, 950 bp, Homo sapiens
aacaaagttcagtgactgagagggctgagcggaggctgctgaaggggagaaaggagtgaggagctgctgggcagagagggactgtccggctcccagatgctgggcctcctggggagcacagccctcgtgggatggatcacaggtgctgctgtggcggtcctgctgctgctgctgctgctggccacctgccttttccacggacggcaggactgtgacgtggagaggaaccgtacagctgcagggggaaaccgagtccgccgggcccagccttggcccttccggcggcggggccacctgggaatctttcaccatcaccgtcatcctggccacgtatctcatgtgccgaatgtgggcctccaccaccaccaccacccccgccacacccctcaccacctccaccaccaccaccacccccaccgccaccatccccgccacgctcgctgaggctgctgtcgccggtgcctgtggacagcagctgcccctgccctcccatctgttcccaggacaagtggaccccatgtttccatgtggaaggatgcatctctggggtgaacgaggggaacaatagactggggcttgctccagctgcatttgcatggcatgccccagtgtactatggcagcagagaatggaggaacactgggtctgcagtgctgaagggtttggggagtggagagcaagggtgctctttcggggctggacagcccgtcttgtgacagtgactcccagtgagccccagaaatgacaagcgtgtcttggcagagccagcacacaagtggatgtgaagtgcccgtcttgacctcctcatcaggctgctgcaggcctctggcgggcagggcactgggagaggccctgagaatgtccttttggtttggagaaggcagtgtgaggctgcacagtcaattcatcggtgccttagtccaagaaaataaaaaccactaagaagcttt

SEQ ID NO: 2809 - DNA, 2747 bp, Homo sapiens
aatgtttggatttctccaccaggagggaggacaaacaagctttcttcttgccttctgggcagctttgtgtgctctccagcacggagtccgaggaggaacagcgaagctgaaaatgaaaattactctggcgctggacccaatcgctcctctacggcatcaatctcatcggacccccccaccctaccgcctctcagaaatgaccacttttgcaaaattgcatgcatttccaagcttcatccggctccaggcttggcctctcccagaggcaggcggcttgtgagacgggctccagagaaaggacctccctgggtctctcatttcctggctgaagtttctcttctcgctgctgtggcagcatccaacccacacacacaggacccgcatcctgggtgatgaagtcagacacgcagcagctgggtgagtgctaacgctcagataagcatctgtgccattgtggggactccctgggctgctctgcacccggacacttgctctgtccccgccatgtacaacgggtcgtgctgccgcatcgagggggacaccatctcccaggtgatgccgccgctgctcattgtggcctttgtgctgggcgcactaggcaatggggtcgccctgtgtggtttctgcttccacatgaagacctggaagcccagcactgtttaccttttcaatttggccgtggctgatttcctccttatgatctgcctgccttttcggacagactattacctcagacgtagacactgggcttttggggacattccctgccgagtggggctcttcacgttggccatgaacagggccgggagcatcgtgttccttacggtggtggctgcggacaggtatttcaaagtggtccacccccaccacgcggtgaacactatctccacccgggtggcggctggcatcgtctgcaccctgtgggccctggtcatcctgggaacagtgtatcttttgctggagaaccatctctgcgtgcaagagacggccgtctcctgtgagagcttcatcatggagtcggccaatggctggcatgacatcatgttccagctggagttctttatgcccctcggcatcatcttattttgctccttcaagattgtttggagcctgaggcggaggcagcagctggccagacaggctcggatgaagaaggcgacccggttcatcatggtggtggcaattgtgttcatcacatgctacctgcccagcgtgtctgctagactctatttcctctggacggtgccctcgagtgcctgcgatccctctgtccatggggccctgcacataaccctcagcttcacctacatgaacagcatgctggatcccctggtgtattatttttcaagcccctcctttcccaaattctacaacaagctcaaaatctgcagtctgaaacccaagcagccaggacactcaaaaacacaaaggccggaagagatgccaatttcgaacctcggtcgcaggagttgcatcagtgtggcaaatagtttccaaagccagtctgatgggcaatgggatccccacattgttgagtggcactgaacaagcagaccaacaacactgaggaagatagagtggtgacttagaattaactcgtgctaaggggtcgggggctttgaaaatgccacccccctttcttattgcaagacggcttctcgcacatgaactgcatccttctcattctgtcggaaatgaaattcacacaactataccttttggggaggttccagttgattgaacagggtgttgccaactcatggtgcatggattcaaatgcaataaacagtcctggggagatgtcccgctcctgtagccccatcatgggtgtctgatttgaccctgtactcgatggatcagctggcaccacccggatcgataaactggctcatctggtcttgtggccctcacccaggaactgattcaggacaagaggacatctttgactccctgtgatttcatctccaacctgaccaatcagcactccccactttctgaaccgctatcggccaagttatccttaaaaacccagatccaggccgggcacagtggttcacgcctgtaatcccagcactttgggaggccgaggcgggtggatcacctgaggtgagaagttcgagaccagcctggccaacatagcgaaactccatctctacaaaaatacaaaaattagccaggcgtggtggcacaagcctgtagtccaaactacttgggaggctaagagtgttccaaccacatcctccagggaaaatccctcgaccaagagtccaatctgattttgcacttccctgacttcttgctaagccgtctacaccaggagggtttgctgaaatgaaaatgcgaccttttgcaagggacatgcaagatgaaaccttctatttccttggcagcccagaggaatcatgtgcacgataccttaatttgctggtgtcttttctctgagtggggcatgagcatcagacaagctaatgcaaaagccggaagttctaactggatatactgcctggcgactccgatcaggtcaagatcacctgagactggacatcttcgagagagaacattaattagttaataatctggcagattcactagattatattggcctttctagctttccatagtcatctgcctgtccaagttttcaataattttaaacactaaagtgctggtgcatgacatatgcttaggaatgagtaacacaagtctttgacagcactctacacagaataaaagaatttacccatggg

SEQ ID NO: 2810 - DNA, 3612 bp, Homo sapiens
agaggcaggcggcttgtgagacgggctccagagaaaggacctccctgggtctctcatttcctggctgaagtttctcttctcgctgctgtggcagcatccaacccacacacacaggacccgcatcctgggtgatgaagtcagacacgcagcagctgggtgagtgctaacgctcagataagcatctgtgccattgtggggactccctgggctgctctgcacccggacacttgctctgtccccgccatgtacaacgggtcgtgctgccgcatcgagggggacaccatctcccaggtgatgccgccgctgctcattgtggcctttgtgctgggcgcactaggcaatggggtcgccctgtgtggtttctgcttccacatgaagacctggaagcccagcactgtttaccttttcaatttggccgtggctgatttcctccttatgatctgcctgccttttcggacagactattacctcagacgtagacactgggcttttggggacattccctgccgagtggggctcttcacgttggccatgaacagggccgggagcatcgtgttccttacggtggtggctgcggacaggtatttcaaagtggtccacccccaccacgcggtgaacactatctccacccgggtggcggctggcatcgtctgcaccctgtgggccctggtcatcctgggaacagtgtatcttttgctggagaaccatctctgcgtgcaagagacggccgtctcctgtgagagcttcatcatggagtcggccaatggctggcatgacatcatgttccagctggagttctttatgcccctcggcatcatcttattttgctccttcaagattgtttggagcctgaggcggaggcagcagctggccagacaggctcggatgaagaaggcgacccggttcatcatggtggtggcaattgtgttcatcacatgctacctgcccagcgtgtctgctagactctatttcctctggacggtgccctcgagtgcctgcgatccctctgtccatggggccctgcacataaccctcagcttcacctacatgaacagcatgctggatcccctggtgtattatttttcaagcccctcctttcccaaattctacaacaagctcaaaatctgcagtctgaaacccaagcagccaggacactcaaaaacacaaaggccggaagagatgccaatttcgaacctcggtcgcaggagttgcatcagtgtggcaaatagtttccaaagccagtctgatgggcaatgggatccccacattgttgagtggcactgaacaagcagaccaacaacactgaggaagatagagtggtgacttagaattaactcgtgctaaggggtcgggggctttgaaaatgccacccccctttcttattgcaagacggcttctcgcacatgaactgcatccttctcattctgtcggaaatgaaattcacacaactataccttttggggaggttccagttgattgaagtgagttggctgcattttcttatctgatcacaatggcaggggacagaatgtgcatggagtggagcatgtgtgtgttgggaggggggctaggaactgcacagcccttgtgtaattttcgttgtttgtttttgttttgagacagagtctcactctgtgtcccaggctggagtgcagtggcacagtctcggctcactgcaacctctgcctcccgggttcaagcaattctcctgcctcagcctcccgagtagctgggattagaggcgccagccaacacacccggctaatttttgtatttttagtagagacagggttttgccatgttggccaggctggtctcgagctcctgacctcaggtgatccgcctgccttggcctcccaaagtggtgggatcacaggcgtgagccaccgtgcctggcctcccctgtgtcattttaaatggctaagtaaatgggtatatgtgtttgaatggggcatgttcactctcttaggggctatggggcagttagcagcatttcctatcctctgaccttaaatcattccttatctcagaaaacagaaaccgggctcagtcaatcaatgctttatttcaggccgaatgaggctctttagattgggatctattgatctatcaattttcatctttacatttctttgtacatctgtacattttgtccaaatgtacatctgtacgtctgtcatcattgtgacttcctggtagcccaagaagaacaacaacaaaacaatctgctctgaccttcttcaaatctttgtatttcaaagaaggtgctgagggatctgtttccttgccctggcttctccagtgggatgtgctgagtccaatacaattgcttttataattgcttttgacaacttgtcatgtgactgtgaattgaaattattcacttattttccaagtatttactgaattcgtatttggtggcaggcagtatactgtgtaatttttagtggagggtcattagtcaactcttatgtgacagtaaagttttttgggggggtggggacagagaagttaagagctttcatcctttcacggaatacagtttctagaccgattctgtgtgaacatcagttttgtcctcttattgcaagactccctcatacacatgagtttcccaaatgtgtacctggacccctcgaaacagaggactctacgaaatgacaagctgcccctgccctgaattagggggaaacattccaggccaactctagctcctttctcaagctacaaagtggtgaacatggttctcaactccttaatttatactctctcaaatgcccaggatactctacccacttaagaaccttgccaacttctgggggttgggcatggtggctcacgcttgtgatcccagcactttgggagactgaggcggatcacctgaggtcaggagttctagaccagcctgaccaacatggagaaacctcgtctctactaaaaattcaaaattagcctggtgtggtggcgcatgcctataatcccagcctccagagtagctgggactacgggcgccccaccaccacgcccggctaattttttgtatttttagtacagacggggtttcattgtgttagccgggatggtcttgatctcctgacttgtgatccgcctgcctcggcctcccaaagtgcttggattacaggtgtaagccaccgcaccccgcccagcctggcagattttatttaatcatttgtagcttcattttcctcgtctgtcaaacagggatactgtaatacaacctcagtgtgtcattgggcagtttaaatgaatgtacattcctgaggcatcagaactttgttcactgttatatacccaatgcctagaagaggacctgcacatagcaggtgctcagtaaatgtttgttgaatgaatgattaagtgcatgtaaagcattaagcatagcgcctggcagtaagtgctcaatattatgacttcttatattaacacgttttacatataaagaaatggaggcaagaaagcatttcctttggggtttagagcgcttaagttgttcctctgttatcatgcctgaattcccccgcccctcagttacctggggaagagtaaaggcaagaattcttaccagcattagtcatacatcctcctgatagg

SEQ ID NO: 2811 - DNA, 2639 bp, Homo sapiens
aatgtttggatttctccaccaggagggaggacaaacaagctttcttcttgccttctgggcagctttgtgtgctctccagcacggagtccgaggaggaacagcgaagctgaaaatgaaaattactctggcgctggacccaatcgctcctctacggcatcaatctcatcggacccccccaccctaccgcctctcagaaatgaccacttttgcaaaattgcatgcatttccaagcttcatccggctccaggcttggcctctcccagaggcaggcggcttgtgagacgggctccagagaaaggacctccctgggtctctcatttcctggctgaagtttctcttctcgctgctgtggcagcatccaacccacacacacaggacccgcatcctgggtgatgaagtcagacacgcagcagctgggtgagtgctaacgctcagataagcatctgtgccattgtggggactccctgggctgctctgcacccggacacttgctctgtccccgccatgtacaacgggtcgtgctgccgcatcgagggggacaccatctcccaggtgatgccgccgctgctcattgtggcctttgtgctgggcgcactaggcaatggggtcgccctgtgtggtttctgcttccacatgaagacctggaagcccagcactgtttaccttttcaatttggccgtggctgatttcctccttatgatctgcctgccttttcggacagactattacctcagacgtagacactgggcttttggggacattccctgccgagtggggctcttcacgttggccatgaacagggccgggagcatcgtgttccttacggtggtggctgcggacaggtatttcaaagtggtccacccccaccacgcggtgaacactatctccacccgggtggcggctggcatcgtctgcaccctgtgggccctggtcatcctgggaacagtgtatcttttgctggagaaccatctctgcgtgcaagagacggccgtctcctgtgagagcttcatcatggagtcggccaatggctggcatgacatcatgttccagctggagttctttatgcccctcggcatcatcttattttgctccttcaagattgtttggagcctgaggcggaggcagcagctggccagacaggctcggatgaagaaggcgacccggttcatcatggtggtggcaattgtgttcatcacatgctacctgcccagcgtgtctgctagactctatttcctctggacggtgccctcgagtgcctgcgatccctctgtccatggggccctgcacataaccctcagcttcacctacatgaacagcatgctggatcccctggtgtattatttttcaagcccctcctttcccaaattctacaacaagctcaaaatctgcagtctgaaacccaagcagccaggacactcaaaaacacaaaggccggaagagatgccaatttcgaacctcggtcgcaggagttgcatcagtgtggcaaatagtttccaaagccagtctgatgggcaatgggatccccacattgttgagtggcactgaacaagcagaccaacaacactgaggaagatagagtggtgacttagaattaactcgtgctaaggggtcgggggctttgaaaatgccacccccctttcttattgcaagacggcttctcgcacatgaactgcatccttctcattctgtcggaaatgaaattcacacaactataccttttggggaggttccagttgattgaagtgagttggctgcattttcttatctgatcacaatggcaggggacagaatgtgcatggagtggagcatgtgtgtgttgggaggggggctaggaactgcacagcccttgtgtaattttcgttgtttgtttttgttttgagacagagtctcactctgtgtcccaggctggagtgcagtggcacagtctcggctcactgcaacctctgcctcccgggttcaagcaattctcctgcctcagcctcccgagtagctgggattagaggcgccagccaacacacccggctaatttttgtatttttagtagagacagggttttgccatgttggccaggctggtctcgagctcctgacctcaggtgatccgcctgccttggcctcccaaagtggtgggatcacaggcgtgagccaccgtgcctggcctcccctgtgtcattttaaatggctaagtaaatgggtatatgtgtttgaatggggcatgttcactctcttaggggctatggggcagttagcagcatttcctatcctctgaccttaaatcattccttatctcagaaaacagaaaccgggctcagtcaatcaatgctttatttcaggccgaatgaggctctttagattgggatctattgatctatcaattttcatctttacatttctttgtacatctgtacattttgtccaaatgtacatctgtacgtctgtcatcattgtgacttcctggtagcccaagaagaacaacaacaaaacaatctgctctgaccttcttcaaatctttgtatttcaaagaaggtgctgagggatctgtttccttgccctggcttctccagtgggatgtgctgagtccaatacaattgcttttataattgcttttgacaacttgtcatgtgactgtgaattgaaatt

SEQ ID NO: 2812 - DNA, 2051 bp, Homo sapiens
cacctccttgctggagcattcactaggcgaggcgctccatcggactcactagccgcactcatgaatcggcaccatctgcaggatcactttctggaaatagacaagaagaactgctgtgtgttccgagatgacttcattgtcaaggtgttgccgccggtgttggggctggagtttatcttcgggcttctgggcaatggccttgccctgtggattttctgtttccacctcaagtcctggaaatccagccggattttcctgttcaacctggcagtggctgactttctactgatcatctgcctgcccttcctgatggacaactatgtgaggcgttgggactggaagtttggggacatcccttgccggctgatgctcttcatgttggctatgaaccgccagggcagcatcatcttcctcacggtggtggcggtagacaggtatttccgggtggtccatccccaccacgccctgaacaagatctccaatcggacagcagccatcatctcttgccttctgtggggcatcactattggcctgacagtccacctcctgaagaagaagatgccgatccagaatggcggtgcaaatttgtgcagcagcttcagcatctgccataccttccagtggcacgaagccatgttcctcctggagttcttcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggtgagccatggagcccctcttatctgggcccaacctctccttaaataaccatgccaagaagggacattgtcaccaagaaccaggatctctggagaaacagttgggctgttgcatcgagtaatgtcactggactcggcctaaggtttcctggaacttccagattcagagaatgcgatttagggaaacggtggcagatgagtgggagactggttgcaaggtgtgaccgcaggaatcctggaggaatagagagtaaagcttctaggcatctgaaacttttgcttcatctctgacgctcgcaggactgaagatgggcaaattgtaggcatttctgctgagcagagttggagccagagatctacttgtgacttgttggccttcttcccacatctgcctcagactggagggggctcagctcctggggtgatatctagcctgcttgtgagctctagcagggataaggagagctgagattggagggaattgtgttgctcctggagggagcccaggcatcattaaacaagccagtaggtcacctggcttccgtggaccaattcatctttcagacaagctttagcagaaatggactcagggaagagactcacacgctttggttaatatctgtgtttccggtgggtgtaataggggattagccccagaagggactgagctaaacagtgttattatgggaaaggaaatggcattgctgctttcaaccagcgactaatgcaatccattcctctcttgtttatagtaatctaagggttgggcagttaaaacggcttcaggatagaaagctgtttcccacctctgtttgcttttaacattaaaagggaaatgtgcctctgccccacagttagaggggtgcacgttcctcctggttccttcgcttgtgtttctgtacttaccaaaaatctaccatttcaataaattttgataggagaca

SEQ ID NO: 2813 - DNA, 1164 bp, Homo sapiens
atgaatcggcaccatctgcaggatcactttctggaaatagacaagaagaactgctgtgtgttccgagatgacttcattgtcaaggtgttgccgccggtgttggggctggagtttatcttcgggcttctgggcaatggccttgccctgtggattttctgtttccacctcaagtcctggaaatccagccggattttcctgttcaacctggcagtggctgactttctactgatcatctgcctgcccttcctgatggacaactatgtgaggcgttgggactggaagtttggggacatcccttgccggctgatgctcttcatgttggctatgaaccgccagggcagcatcatcttcctcacggtggtggcggtagacaggtatttccgggtggtccatccccaccacgccctgaacaagatctccaatcggacagcagccatcatctcttgccttctgtggggcatcactattggcctgacagtccacctcctgaagaagaagatgccgatccagaatggcggtgcaaatttgtgcagcagcttcagcatctgccataccttccagtggcacgaagccatgttcctcctggagttcttcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggtgagccatggagcccctcttatctgggcccaacctctaataaccatgccaagaagggacattgtcaccaagaaccaggatctctggagaaacagttgggctgttgcatcgagtaa

SEQ ID NO: 2814 - DNA, 1512 bp, Homo sapiens
agcagttggggcaggaggaagccgactgctgcctggtctgcaaagaagtcctttcaagtctctaggactggactcttcctaagcaagtccgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagagcatcgctgcagctactcagtgggtgaaggagcatgtgggggacagaggactctggggactggtgaacaatgcaggcattcttacaccaattaccttatgtgagtggctgaacactgaggactctatgaatatgctcaaagtgaacctcattggtgtgatccaggtgaccttgagcatgcttcctttggtgaggagagcacggggaagaattgtcaatgtctccagcattctgggaagagttgctttctttgtaggaggctactgtgtctccaagtatggagtggaagccttttcagatattctgaggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttgaaatgggtctgtattatggtacttttaataaatatttgatttttctttctcttc

SEQ ID NO: 2815 - DNA, 1547 bp, Homo sapiens
acttggtgcgcgcgggggctgcgggagacgcagcagtttgcgatctgcccacgcgttcgggcactagggccaccgctcttgtgggcagaaggccgcgtccattccaggaagaggatcttctccggaaatatctgattctgcagctgatcaaggatgacactggtgagaaccctatgagggagtgaagcagcctggactcttaccacaagagggaggtgttataagagcaatgcagaggttggagtgggcagcagttggggcaggaggaagccgactgctgcctggtctgcaaagaagtcctttcaagtctctaggactggactcttcctaagcaagtccgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagagcatcgctgcagctactcagtgggtgaaggagcatgtgggggacagaggactctggggactggtgaacaatgcaggcattcttacaccaattaccttatgtgagtggctgaacactgaggactctatgaatatgctcaaagtgaacctcattggtgtgatccaggtgaccttgagcatgcttcctttggtgaggagagcacggggaagaattgtcaatgtctccagcattctgggaagagttgctttctttgtaggaggctactgtgtctccaagtatggagtggaagccttttcagatattctgaggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaa

SEQ ID NO: 2816 - DNA, 592 bp, Homo sapiens
agtttgcgatctgcccacgcgttcgggcactagggccaccgctcttgtgggcagaaggccgcgtccattccaggaagaggatcttctccggaaattaacagatctgattctgcagctgatcaaggatgacactggtgagaaccctatgagggagtgaagcagcctggactcttaccacaagagggaggtgttataagagcaatgcagaggttggagtgggcagcagttggggcaggaggaagccgactgctgcctggtctgcaaagaagtcctttcaagtctctaggactggactcttcctaagcaagtccggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagag

SEQ ID NO: 2817 - DNA, 1751 bp, Homo sapiens
tcccacttggtgcgcgcgggggctgcgggagacgcagcagtttgcgatctgcccacgcgttcgggcactagggccaccgctcttgtgggcagaaggccgcgtccattccaggaagaggatcttctccggaaatctgatcaaggatgacactggtgagaaccctatgagggagtgaagcagcctggactcttaccacaagagggaggtgttataagagcaatgcagaggttggagtgggcagcagttggggcaggaggaagccgactgctgcctggtctgcaaagaagtcctttcaagtctctaggactggactcttcctaagcaagtccgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagagcatcgctgcagctactcagtgggtgaaggagcatgtgggggacagaggactctggggactggtgaacaatgcaggcattcttacaccaattaccttatgtgagtggctgaacactgaggactctatgaatatgctcaaagtgaacctcattggtgtgatccaggtgaccttgagcatgcttcctttggtgaggagagcacggggaagaattgtcaatgtctccagcattctgggaagagttgctttctttgtaggaggctactgtgtctccaagtatggagtggaagccttttcagatattctgaggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttgaaatgggtctgtattatggtacttttaataaatatttgatttttctttctcttc

SEQ ID NO: 2818 - DNA, 1525 bp, Homo sapiens
actccgctcccgaacccattcctcgcctccatcacctccaccgtagttgagccagcgatagtactgagagtagggaaagagcctccggtaataaagtttaagcagctcgggcagctcggtggggtcaaacgtctccattgagcgcggaactcgccacgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagagcatcgctgcagctactcagtgggtgaaggagcatgtgggggacagaggactctggggactggtgaacaatgcaggcattcttacaccaattaccttatgtgagtggctgaacactgaggactctatgaatatgctcaaagtgaacctcattggtgtgatccaggtgaccttgagcatgcttcctttggtgaggagagcacggggaagaattgtcaatgtctccagcattctgggaagagttgctttctttgtaggaggctactgtgtctccaagtatggagtggaagccttttcagatattctgaggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttg

SEQ ID NO: 2819 - DNA, 1722 bp, Homo sapiens
actccgctcccgaacccattcctcgcctccatcacctccaccgtagttgagccagcgatagtactgagagtagggaaagagcctccggtaataaagtttaagcagctcgggcagctcggtggggtcaaacgtctccattgagcgcggaactcgccacgctgatcaaggatgacactggtgagaaccctatgagggagtgaagcagcctggactcttaccacaagagggaggtgttataagagcaatgcagaggttggagtgggcagcagttggggcaggaggaagccgactgctgcctggtctgcaaagaagtcctttcaagtctctaggactggactcttcctaagcaagtccgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagagcatcgctgcagctactcagtgggtgaaggagcatgtgggggacagaggactctggggactggtgaacaatgcaggcattcttacaccaattaccttatgtgagtggctgaacactgaggactctatgaatatgctcaaagtgaacctcattggtgtgatccaggtgaccttgagcatgcttcctttggtgaggagagcacggggaagaattgtcaatgtctccagcattctgggaagagttgctttctttgtaggaggctactgtgtctccaagtatggagtggaagccttttcagatattctgaggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttg

SEQ ID NO: 2820 - DNA, 591 bp, Homo sapiens
acttggtgcgcgcgggggctgcgggagacgcagcagtttgcgatctgcccacgcgttcgggcactagggccaccgctcttgtgggcagaaggccgcgtccattccaggaagaggatcttctccggaaattaacagatctgattctgcagctgatcaaggatgacactggtgagaaccctatgagggagtgaagcagcctggactcttaccacaagagggaggtgttataagagcaatgcagaggttggagtgggcagcagttggggcaggaggaagccgactgctgcctggtctgcaaagaagtcctttcaagtctctaggactggactcttcctaagcaagtccgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgaca

SEQ ID NO: 2821 - DNA, 3661 bp, Homo sapiens
gtacgcgggtcacgtgagggcgcggcgcggcagcagctccggcggccgagacgggggcggcggccgcgcgggtctggcgggaccggtttggaagactttgccggcctgcagattggccttaagagaaggacggagccacatactgctgacggcccagaactggcagagagaaggttgccatggctgctgttgacagtttctacctcttgtacagggaaatcgccaggtcttgcaattgctatatggaagctctagctttggttggagcctggtatacggccagaaaaagcatcactgtcatctgtgacttttacagcctgatcaggctgcattttatcccccgcctggggagcagagcagacttgatcaagcagtatggaagatgggccgttgtcagcggtgcaacagatgggattggaaaagcctacgctgaagagttagcaagccgaggtctcaatataatcctgattagtcggaacgaggagaagttgcaggttgttgctaaagacatagccgacacgtacaaagtggaaactgatattatagttgcggacttcagcagcggtcgtgagatctaccttccaattcgagaagccctgaaggacaaagacgttggcatcttggtaaataacgtgggtgtgttttatccctacccgcagtatttcactcagctgtccgaggacaagctctgggacatcataaatgtgaacattgccgccgctagtttgatggtccatgttgtgttaccgggaatggtggagagaaagaaaggtgccatcgtcacgatctcttctggctcctgctgcaaacccactcctcagctggctgcattttctgcttctaaggcttatttagaccacttcagcagagccttgcaatatgaatatgcctctaaaggaatctttgtacagagtctaatccctttctatgtagccaccagcatgacagcacccagcaactttctgcacaggtgctcgtggttggtgccttcgccaaaagtctatgcacatcatgctgtttctactcttgggatttccaaaaggaccacaggatattggtcccattctattcagtttctttttgcacagtatatgcctgaatggctctgggtgtggggagcaaatattctcaaccgttcactacgtaaggaagccttatcctgcacagcctgagtctggatggccacttgagaagttttgccaactcctgggaacctcgatattctgacatttggaaaaacacatttaatttatctcctgtgtttcattgctgattattcagcatactgttgattcgtcatttgcaaaacacacataataccgtcagagtgctgtgaaaaaccttaagggtgtgtggatggcacaggatcaataatgcctgaggctgattgacgacatctacatttcagtgctttttccctaagctgtttgaaagttacgcttttctgttgttctagagccacagcagtctaatattgaaatataatatgatttgtcaggtcttataatttcagatgttgttttttaagggaaattgaccatttcactagaggagttgtgctggtttttaaatgtgcatcaagaaagactactgaaaagtattattttgtaactaagattgctggtactattaggaaaaatctgtgtgtattgtatagctctagctgtttgactatctgtaatgaaaatgctgcacttcaactggtatttcattagagaaccgtgtgtgtgcgtgtgtgtggtgcctttgagcaactttatttatggttaccatatttttaaaaagattttttgtcagggtgacttaacatggactcttatagggtattaaaacaatctagattattccttttcatcctaaataagcctaccaaatttcatgctgttggtttgccatgaatgatattacttcctacattatatttgtgttttttcaaatctgctatggaatgaacttattcctagatttggatatgtaagagaaacctgcagtcatcttttgatttataaggcaattcttgtggataaatagtgatttctcagcctctgacccattttataactgaaatttagccctttagagcttgttatatctggttttcctacgtttttctatgtaatattattccattccagtagcattattgatagaaatagtaagtatttatggaatagtaaaatatggacaaattacgtgtgtgacatatctgtcaatataagttagaagcttattcttggtttgtgtaatgaatttatgtattgtagtgaatacctttactggtgtgaagataattatgcacaaaccctcacaatacgcgttaacattgaaacctgtgaaatgtccttagtttgggtcatataaagccaaccatttttgaggaccatgtacctagtgctttgaaaactctaagtcactatatgaatatgacaatatgtgcacatttaaaattcagagctcggcattgtgatactgatgcagaagctagtagattggttaaaagtctggacttctgtggcatttttttcgtgacgtgataatctatcataagcagacctaagcacagttttatgaacacaattttgcccatgacattgcctacaggatttccagatgtgacttgcactcagaagatcagtggtcaacttcagaagctcttccacgcttagatcatgtcttcagaacttagatgtgaaaatctacacactgggagatgctgtgagccccaaggttttgatggagtttgcttggaatcctcttgacttcatgccacattgacgtgaactttgatgtataataagcagcagcaacttcatgtgaaaatatggtcaggtagttatatgtaaggttacgtggtccagtaatgtcttagattgataaattaggtatggaatccatcagtgttacgtgatgagaataggtgaacacaccttgtcagtgatgatgtaaacttctctccttggcaggacatgggcaaacatgctgattggtgcaaatgtggtgccgagctgtccatagctgcagtgaaagatgaagagcaagaccttctctaggttttctagctttcattaaatgtatttttttccccagagctaatttgaaagttgattggaccactgtggatggggtgtcattaagaatgtgggaaataggggccgagtgcggtggctcacacctgtaatcccagcagtttggaaggccagggcaggtggatcgcttgatcccaggaggtcgagaccagcctggggaacacatcctgtctctacaaaaaatacaaaaattagccaggcagggtggtgcatgcctgtagtcccagctacttgggaggctgaggcaggagaattttttgagcccaggatgcagaggttgaagtgagccaagatcgtgccactgcactccagccttgagacagagcgagaccctgtctcaaaaaaaaaaaaagaacgtgggaaatatgaacctttgaaagttaatctgtgaattgaaagtttaacaataaaagtagttgtttgtttcctttggaagagttttgttccagatgtttgtaatttggttgtttgtaatttggaatgagagaatttttttttcttaggagtgattgcaagaaattaacatgaacaacagtggtcataactgattaaaagctgacacgtcagtaacaaaa

SEQ ID NO: 2822 - DNA, 3503 bp, Homo sapiens
ggcgcgtacgcgggtcacgtgagggcgcggcgcggcagcagctccggcggccgagacgggggcggcggccgcgcgggtctggcgggaccggtttggaagactttgccggcctgcagattggccttaagagaaggacggagccacatactgctgacggcccagaactggcagagagaaggttgccatggctgctgttgacagtttctacctcttgtacagggaaatcgccaggtcttgcaattgctatatggaagctctagctttggttggagcctggtatacggccagaaaaagcatcactgtcatctgtgacttttacagcctgatcaggctgcattttatcccccgcctggggagcagagcagacttgatcaagcagtatggaagatgggccgttgtcagcggtgcaacagatgggattggaaaagcctacgctgaagagttagcaagccgaggtctcaatataatcctgattagtcggaacgaggagaagttgcagtatttcactcagctgtccgaggacaagctctgggacatcataaatgtgaacattgccgccgctagtttgatggtccatgttgtgttaccgggaatggtggagagaaagaaaggtgccatcgtcacgatctcttctggctcctgctgcaaacccactcctcagctggctgcattttctgcttctaaggcttatttagaccacttcagcagagccttgcaatatgaatatgcctctaaaggaatctttgtacagagtctaatccctttctatgtagccaccagcatgacagcacccagcaactttctgcacaggtgctcgtggttggtgccttcgccaaaagtctatgcacatcatgctgtttctactcttgggatttccaaaaggaccacaggatattggtcccattctattcagtttctttttgcacagtatatgcctgaatggctctgggtgtggggagcaaatattctcaaccgttcactacgtaaggaagccttatcctgcacagcctgagtctggatggccacttgagaagttttgccaactcctgggaacctcgatattctgacatttggaaaaacacatttaatttatctcctgtgtttcattgctgattattcagcatactgttgattcgtcatttgcaaaacacacataataccgtcagagtgctgtgaaaaaccttaagggtgtgtggatggcacaggatcaataatgcctgaggctgattgacgacatctacatttcagtgctttttccctaagctgtttgaaagttacgcttttctgttgttctagagccacagcagtctaatattgaaatataatatgatttgtcaggtcttataatttcagatgttgttttttaagggaaattgaccatttcactagaggagttgtgctggtttttaaatgtgcatcaagaaagactactgaaaagtattattttgtaactaagattgctggtactattaggaaaaatctgtgtgtattgtatagctctagctgtttgactatctgtaatgaaaatgctgcacttcaactggtatttcattagagaaccgtgtgtgtgcgtgtgtgtggtgcctttgagcaactttatttatggttaccatatttttaaaaagattttttgtcagggtgacttaacatggactcttatagggtattaaaacaatctagattattccttttcatcctaaataagcctaccaaatttcatgctgttggtttgccatgaatgatattacttcctacattatatttgtgttttttcaaatctgctatggaatgaacttattcctagatttggatatgtaagagaaacctgcagtcatcttttgatttataaggcaattcttgtggataaatagtgatttctcagcctctgacccattttataactgaaatttagccctttagagcttgttatatctggttttcctacgtttttctatgtaatattattccattccagtagcattattgatagaaatagtaagtatttatggaatagtaaaatatggacaaattacgtgtgtgacatatctgtcaatataagttagaagcttattcttggtttgtgtaatgaatttatgtattgtagtgaatacctttactggtgtgaagataattatgcacaaaccctcacaatacgcgttaacattgaaacctgtgaaatgtccttagtttgggtcatataaagccaaccatttttgaggaccatgtacctagtgctttgaaaactctaagtcactatatgaatatgacaatatgtgcacatttaaaattcagagctcggcattgtgatactgatgcagaagctagtagattggttaaaagtctggacttctgtggcatttttttcgtgacgtgataatctatcataagcagacctaagcacagttttatgaacacaattttgcccatgacattgcctacaggatttccagatgtgacttgcactcagaagatcagtggtcaacttcagaagctcttccacgcttagatcatgtcttcagaacttagatgtgaaaatctacacactgggagatgctgtgagccccaaggttttgatggagtttgcttggaatcctcttgacttcatgccacattgacgtgaactttgatgtataataagcagcagcaacttcatgtgaaaatatggtcaggtagttatatgtaaggttacgtggtccagtaatgtcttagattgataaattaggtatggaatccatcagtgttacgtgatgagaataggtgaacacaccttgtcagtgatgatgtaaacttctctccttggcaggacatgggcaaacatgctgattggtgcaaatgtggtgccgagctgtccatagctgcagtgaaagatgaagagcaagaccttctctaggttttctagctttcattaaatgtatttttttccccagagctaatttgaaagttgattggaccactgtggatggggtgtcattaagaatgtgggaaataggggccgagtgcggtggctcacacctgtaatcccagcagtttggaaggccagggcaggtggatcgcttgatcccaggaggtcgagaccagcctggggaacacatcctgtctctacaaaaaatacaaaaattagccaggcagggtggtgcatgcctgtagtcccagctacttgggaggctgaggcaggagaattttttgagcccaggatgcagaggttgaagtgagccaagatcgtgccactgcactccagccttgagacagagcgagaccctgtctcaaaaaaaaaaaaagaacgtgggaaatatgaacctttgaaagttaatctgtgaattgaaagtttaacaataaaagtagttgtttgtttcctttggaagagttttgttccagatgtttgtaatttggttgtttgtaatttggaatgagagaatttttttttcttaggagtgattgcaagaaattaacatgaacaacagtggtcataactgattaaaagctgacacgtcagtaacaaaatt

SEQ ID NO: 2823 - DNA, 5405 bp, Homo sapiens
ggcgccgggcggccggcgagtctggagcccgcgccgtcgccggccgcgtcctccgggcatggaaggaggcggcaagcccaactcttcgtctaacagccgggacgatggcaacagcgtcttccccgccaaggcgtccgcgacgggcgcggggccggccgcggccgagaagcgcctgggcaccccgccggggggcggcggggccggcgcgaaggagcacggcaactccgtgtgcttcaaggtggacggcggtggcggcggtggcggcggcggcggcggcggcgaggagccggcggggggcttcgaagacgccgaggggccccggcggcagtacggcttcatgcagaggcagttcacctccatgctgcagcccggggtcaacaaattctccctccgcatgtttgggagccagaaggcggtggaaaaggagcaggaaagggttaaaactgcaggcttctggattatccacccttacagtgatttcaggttttactgggatttaataatgcttataatgatggttggaaatctagtcatcataccagttggaatcacattctttacagagcaaacaacaacaccatggattattttcaatgtggcatcagatacagttttcctattggacctgatcatgaattttaggactgggactgtcaatgaagacagttctgaaatcatcctggaccccaaagtgatcaagatgaattatttaaaaagctggtttgtggttgacttcatctcatccatcccagtggattatatctttcttattgtagaaaaaggaatggattctgaagtttacaagacagccagggcacttcgcattgtgaggtttacaaaaattctcagtctcttgcgtttattacgactttcaaggttaattagatacatacatcaatgggaagagatattccacatgacatatgatctcgccagtgcagtggtgagaatttttaatctcatcggcatgatgctgctcctgtgccactgggatggttgtcttcagttcttagtaccactactgcaggacttcccaccagattgctgggtgtctttaaatgaaatggttaatgattcttggggaaagcagtattcatacgcactcttcaaagctatgagtcacatgctgtgcattgggtatggagcccaagccccagtcagcatgtctgacctctggattaccatgctgagcatgatcgtcggggccacctgctatgccatgtttgtcggccatgccaccgctttaatccagtctctggattcttcgaggcggcagtatcaagagaagtataagcaagtggaacaatacatgtcattccataagttaccagctgatatgcgtcagaagatacatgattactatgaacacagataccaaggcaaaatctttgatgaggaaaatattctcaatgaactcaatgatcctctgagagaggagatagtcaacttcaactgtcggaaactggtggctacaatgcctttatttgctaatgcggatcctaattttgtgactgccatgctgagcaagttgagatttgaggtgtttcaacctggagattatatcatacgagaaggagccgtgggtaaaaaaatgtatttcattcaacacggtgttgctggtgtcattacaaaatccagtaaagaaatgaagctgacagatggctcttactttggagagatttgcctgctgaccaaaggacgtcgtactgccagtgttcgagctgatacatattgtcgtctttactcactttccgtggacaatttcaacgaggtcctggaggaatatccaatgatgaggagagcctttgagacagttgccattgaccgactagatcgaataggaaagaaaaattcaattcttctgcaaaagttccagaaggatctgaacactggtgttttcaacaatcaggagaacgaaatcctcaagcagattgtgaaacatgacagggagatggtgcaggcaatcgctcccatcaattatcctcaaatgacaaccctgaattccacatcgtctactacgaccccgacctcccgcatgaggacacaatctccaccggtgtacacagcgaccagcctgtctcacagcaacctgcactcccccagtcccagcacacagaccccccagccatcagccatcctgtcaccctgctcctacaccaccgcggtctgcagccctcctgtacagagccctctggccgctcgaactttccactatgcctcccccaccgcctcccagctgtcactcatgcaacagcagccgcagcagcaggtacagcagtcccagccgccgcagactcagccacagcagccgtccccgcagccacagacacctggcagctccacgccgaaaaatgaagtgcacaagagcacgcaggcgcttcacaacaccaacctgacccgggaagtcaggccactctccgcctcgcagccctcgctgccccatgaggtgtccactctgatttccagacctcatcccactgtgggcgagtccctggcctccatccctcaacccgtgacggcggtccccggaacgggccttcaggcagggggcaggagcactgtcccgcagcgcgtcaccctcttccgacagatgtcgtcgggagccatccccccgaaccgaggagtccctccagcaccccctccaccagcagctgctcttccaagagaatcttcctcagtcttaaacacagacccagacgcagaaaagccacgatttgcttcaaatttatgatccctgctgattgtcaaagcagaaagaaatactctcataaactgagactatactcagatcttattttattctatctcctgatagatccctctagcctactatgaagagatattttagacagctgtggcctacacgtgaaatgtaaaaatatatatacatatactataaaatatatatctaaattcccaagagagggtcaaaagacctgtttagcattcagtgttatatgtcttcctttctttaaatcattaaaggatttaaaatgtcgttgtaagattatttatttctaacctacttttacttaagtcctttgatatgtatatttctctattttatgaagagttcttggattcaatggaaacaaaactgattttaaaaaggcaactcaaatgaactagtaaatagcaccaatcaaaactttctttcattagctgtgtctctgcatctaaattgttaatcattaatggtggagaattaaataacaaatcccattttatagatctaaattgtatttcggtgctttcaatttcaaattaggttaaagaatgcactacttgcttggccaccgtaggagactagcattgccactgtttgttaagaatatcactaacctcaaacatgttcattgatctttcagaaagctgagggaaaattaatatttgtcttcatgtgttatcggacttttaccaagactcgatcaatgttagttgtaaataactttttcaacccaaataaaaatagctattctgtgttgtatgaaggtaaaagtcattgtttaagaatttagttttattgcttcacttcaaaacttagagttttaaattttacaaaacctgattgtgagaattattcaattgtaatgcaatggcttgaaacctacaatattattttaacctgcaatgttttatgcaaaattgtatgctcgaatctacaaattgcttgtattacaccaaaaatcgttacttttctttcttcttgccataatcaagcatctgaaaatagtccctgcatgcttctggggaaaaaaaaataggttcaaatcagtcattgtagagaaaggcttacagtatttctcgtttctagaaaagcataacaattcattaattgcctatcttataattcctataaggctgacttggatctctgacttaagtctagaagtgaggttttcacttttatttaatattattgctattattatttaaataattatttgtaaaccacagcttgatttggagttaagtgttgtctgtgtcttcactgtagctggtaatttactatggtattaatttaaagaaataaattcaatacagcatcacgtctgtttgggaacacacattttgctctatgtatattgtaactaaatggttagtaaactttaaggcatgtggtgactaacgtagcccttagataggaggtttgtcatttttaatgtgttgaaaatagtacagacatggtgacagaaagcaggggtaaagttgaacgtctatgagcattgtctgtctgttttcttaactctttacatgatctgtgagcacctgcttcttctcaaagaactcccttagtaatcatttgtgcctaatgcatcccacacatgtggagtatgactggaacacaattgaaagattcctaacaactggctgcggtaaataacccaagttaagagcatgacttaaagtggaggtcttcagtatctctggcactggcaatacatttaagaacatacagagatcacacattatgtgggacagggcctgcagatagacttgaggacagaaaacaaaaacaaaagcagaaactctaaagtggatccttgctgcctgttatgccttttgtggatataatacctataataccaaaatgagttgttatgtttaatttcaaacaaatcccaactggtgtggaagtaattaactgctagtcgatgtaatgtaatcatcaatatgctggtgacatatgatggcatgtcaggaatactgttgtaagaaagggattgttcagtctacctagaacctatgggaaagctgcaagaccatttacatatcagtacaaaactcctttattttattaaaatatgagaattaacttcaatttattaagattacgtattggtcctttaaattattaaaggtttacatttgataggattaatggatttggtagtgaaatatttttatatatataaatttttggttttttattttgagcactattgggaaacataagcaaaattgaaatgcatggtctttcagtgcaaccatacaatttttattcactttgtaatagaatggacaaaaaaactaaggtttatatattaaactaataaaaaggtacagggtaaattatatacatatatgtatgaatgtatatatacttagattaagaaaaaaaaatgactcacattcctgtaatataaaggtccattgctagttgaaaagtgacctcttttctctgtacatagtgaagcccgtatgtatggagttttaatctgtacagaaagaaatgtattattcattggtctttctgctgctggaaagataatagaatagctgattcttacaacaactgtatgatcagggatgagttagagtatttcttttgtctttgctcaaagccatacatatataaatatatataaagattattaataaattcaacaaaaaataaactacaa

SEQ ID NO: 2824 - DNA, 1170 bp, Homo sapiens
atggagccctcagccaccccaggggcccagatgggggtcccccctggcagcagagagccgtcccctgtgcctccagactatgaagatgagtttctccgctatctgtggcgcgattatctgtacccaaaacagtatgagtgggtcctcatcgcagcctatgtggctgtgttcgtcgtggccctggtgggcaacacgctggtctgcctggccgtgtggcggaaccaccacatgaggacagtcaccaactacttcattgtcaacctgtccctggctgacgttctggtgactgctatctgcctgccggccagcctgctggtggacatcactgagtcctggctgttcggccatgccctctgcaaggtcatcccctatctacaggctgtgtccgtgtcagtggcagtgctaactctcagcttcatcgccctggaccgctggtatgccatctgccacccactattgttcaagagcacagcccggcgggcccgtggctccatcctgggcatctgggctgtgtcgctggccatcatggtgccccaggctgcagtcatggaatgcagcagtgtgctgcctgagctagccaaccgcacacggctcttctcagtctgtgatgaacgctgggcagatgacctctatcccaagatctaccacagttgcttctttattgtcacctacctggccccactgggcctcatggccatggcctatttccagatattccgcaagctctggggccgccagatccccggcaccacctcagcactggtgcggaactggaagcgcccctcagaccagctgggggacctggagcagggcctgagtggagagccccagccccgggcccgcgccttcctggctgaagtgaagcagatgcgtgcacggaggaagacagccaagatgctgatggtggtgctgctggtcttcgccctctgctacctgcccatcagcgtcctcaatgtccttaagagggtgttcgggatgttccgccaagccagtgaccgcgaagctgtctacgcctgcttcaccttctcccactggctggtgtacgccaacagcgctgccaaccccatcatctacaacttcctcagtgggtgtaaagagaagagtctagctctgtcctgcccatcgtgccccggccatgacccgcaccttgctgcagctctgtgtagctaa

SEQ ID NO: 2825 - DNA, 1642 bp, Homo sapiens
cctcccttcaggaagtttgaggctgagacccgaaaagacctgggtgcaagcctccaggcaccctgaagggagtgggctgagggctggcccaagctccctcctctccctctgtagagcctaggatgcccctctgctgcagcggctcctgagctcatggagccctcagccaccccaggggcccagatgggggtcccccctggcagcagagagccgtcccctgtgcctccagactatgaagatgagtttctccgctatctgtggcgcgattatctgtacccaaaacagtatgagtgggtcctcatcgcagcctatgtggctgtgttcgtcgtggccctggtgggcaacacgctggtctgcctggccgtgtggcggaaccaccacatgaggacagtcaccaactacttcattgtcaacctgtccctggctgacgttctggtgactgctatctgcctgccggccagcctgctggtggacatcactgagtcctggctgttcggccatgccctctgcaaggtcatcccctatctacaggctgtgtccgtgtcagtggcagtgctaactctcagcttcatcgccctggaccgctggtatgccatctgccacccactattgttcaagagcacagcccggcgggcccgtggctccatcctgggcatctgggctgtgtcgctggccatcatggtgccccaggctgcagtcatggaatgcagcagtgtgctgcctgagctagccaaccgcacacggctcttctcagtctgtgatgaacgctgggcagatgacctctatcccaagatctaccacagttgcttctttattgtcacctacctggccccactgggcctcatggccatggcctatttccagatattccgcaagctctggggccgccagatccccggcaccacctcagcactggtgcggaactggaagcgcccctcagaccagctgggggacctggagcagggcctgagtggagagccccagccccgggcccgcgccttcctggctgaagtgaagcagatgcgtgcacggaggaagacagccaagatgctgatggtggtgctgctggtcttcgccctctgctacctgcccatcagcgtcctcaatgtccttaagagggtgttcgggatgttccgccaagccagtgaccgcgaagctgtctacgcctgcttcaccttctcccactggctggtgtacgccaacagcgctgccaaccccatcatctacaacttcctcagtggcaaattccgggagcagtttaaggctgccttctcctgctgcctgcctggcctgggtccctgcggctctctgaaggcccctagtccccgctcctctgccagccacaagtccttgtccttgcagagccgatgctccatctccaaaatctctgagcatgtggtgctcaccagcgtcaccacagtgctgccctgagcgagggctgccctggaggctccggctcgggggatctgcccctacccctcatggaaagacagctggatgtggtgaaaggctgtggcttcagtcctgggtttctgcctgtgtgactctggataagtcacttcctctgtctgagcttgtgtcccctaagcagggttgatgtgaggattaagcatgctgaagcaagtggaaagctccttgtaaa

SEQ ID NO: 2826 - DNA, 2001 bp, Homo sapiens
agttgccgcggatcgtgctgagccccgcgagccgaggcagcgcagcctagggagggggctgccccggccccctcctgcagtcccggcccctagaggctcggccttcctcgcaggaaggcgaagtccccggtgccaggtccggggaccagcagccgagaacgcccgggtcccggagccaacaggttcttggtgaagcacttggcacgcatcggagctcattactcctcatcgtggtcctgtaaggaagtttgaggctgagacccgaaaagacctgggtgcaagcctccaggcaccctgaagggagtgggctgagggctggcccaagctccctcctctccctctgtagagcctaggatgcccctctgctgcagcggctcctgagctcatggagccctcagccaccccaggggcccagatgggggtcccccctggcagcagagagccgtcccctgtgcctccagactatgaagatgagtttctccgctatctgtggcgcgattatctgtacccaaaacagtatgagtgggtcctcatcgcagcctatgtggctgtgttcgtcgtggccctggtgggcaacacgctggtctgcctggccgtgtggcggaaccaccacatgaggacagtcaccaactacttcattgtcaacctgtccctggctgacgttctggtgactgctatctgcctgccggccagcctgctggtggacatcactgagtcctggctgttcggccatgccctctgcaaggtcatcccctatctacaggctgtgtccgtgtcagtggcagtgctaactctcagcttcatcgccctggaccgctggtatgccatctgccacccactattgttcaagagcacagcccggcgggcccgtggctccatcctgggcatctgggctgtgtcgctggccatcatggtgccccaggctgcagtcatggaatgcagcagtgtgctgcctgagctagccaaccgcacacggctcttctcagtctgtgatgaacgctgggcagatgacctctatcccaagatctaccacagttgcttctttattgtcacctacctggccccactgggcctcatggccatggcctatttccagatattccgcaagctctggggccgccagatccccggcaccacctcagcactggtgcggaactggaagcgcccctcagaccagctgggggacctggagcagggcctgagtggagagccccagccccgggcccgcgccttcctggctgaagtgaagcagatgcgtgcacggaggaagacagccaagatgctgatggtggtgctgctggtcttcgccctctgctacctgcccatcagcgtcctcaatgtccttaagagggtgttcgggatgttccgccaagccagtgaccgcgaagctgtctacgcctgcttcaccttctcccactggctggtgtacgccaacagcgctgccaaccccatcatctacaacttcctcagtggcaaattccgggagcagtttaaggctgccttctcctgctgcctgcctggcctgggtccctgcggctctctgaaggcccctagtccccgctcctctgccagccacaagtccttgtccttgcagagccgatgctccatctccaaaatctctgagcatgtggtgctcaccagcgtcaccacagtgctgccctgagcgagggctgccctggaggctccggctcgggggatctgcccctacccctcatggaaagacagctggatgtggtgaaaggctgtggcttcagtcctgggtttctgcctgtgtgactctggataagtcacttcctctgtctgagcttgtgtcccctaagcagggttgatgtgaggattaagcatgctgaagcaagtggaaagctccttgtaaactgtgaagtgttgtggacatgattattgttgtacttctctcatttggccataccccacagtataatctgtccccatcctccttccagagcttggtcatcctcctaaagacccctttcctacccaatt

SEQ ID NO: 2827 - DNA, 1837 bp, Homo sapiens
gactgagtgctggaatgaggagtaattgagcttcagctgagccggacgtagctttctcctcctggtgtcattgctgcagcctccagtgccgggtccctagttcctcagctgcctatcttcccggtgcaacatcgcctgtaaagacagcaaagccaccgcagaagttgcccggcagaagactccggaggcattggctcagtaacttttcacgtcattttctgctcgggagccccttctagcctctccgcgcagcctttcccaccgcaaatcaccagtgctcatggggcaggcggagaggagcttgcagcattgagcggaaccggacttgagcccgtgatgtccggcaccaaattggaggactcccccccttgtcgcaactggtcatctgcttcggagctgaatgaaactcaagagccctttttaaaccccaccgactatgacgacgaggaattcctgcggtacctgtggagggaatacctgcacccgaaagaatatgagtgggtcctgatcgccgggtacatcatcgtgttcgtcgtggctctcattgggaacgtcctggtttgtgtggcagtgtggaagaaccaccacatgaggacggtaaccaactacttcatagtcaatctttctctggctgatgtgctcgtgaccatcacctgccttccagccacactggtcgtggatatcactgagacctggttttttggacagtccctttgcaaagtgattccttatctacagaccgtgtcggtgtctgtgtctgtcctcacactgagctgtatcgccttggatcggtggtatgcaatctgtcaccctttgatgtttaagagcacagcaaagcgggcccgtaacagcattgtcatcatctggattgtctcctgcattataatgattcctcaggccatcgtcatggagtgcagcaccgtgttcccaggcttagccaataaaaccaccctctttacggtgtgtgatgagcgctggggtggtgaaatttatcccaagatgtaccacatctgtttctttctggtgacatacatggcaccactgtgtctcatggtgttggcttatctgcaaatatttcgcaaactctggtgtcgacagatccctggaacatcatctgtagttcagagaaaatggaagcccctgcagcctgtttcacagcctcgagggccaggacagccaacgaagtcccggatgagcgctgtggcggctgaaataaagcagatccgagccagaaggaaaacagcccggatgttgatgattgtgcttttggtatttgcaatttgctatctaccaattagcatcctcaatgtgctaaagagagtatttgggatgtttgcccatactgaagacagagagactgtgtatgcctggtttaccttttcacactggcttgtatatgccaatagtgctgcgaatccaattatttataattttctcagtggaaaatttcgagaggaatttaaagctgcgttttcttgctgttgccttggagttcaccatcgccaggaggatcggctcaccaggggacgaactagcacagagagccggaagtccttgaccactcaaatcagcaactttgataacatatcaaaactttctgagcaagttgtgctcactagcataagcacactcccagcagccaatggagcaggaccacttcaaaactggtagaatatttattcatatgacaaggatacctgagtaaaactatcctttttaaaatcactgggaacagaaattttattatcctatgatgtgaagctaaaattacttgtggatcttttttttttttaatctattgctctttggaaataaaaaaaaagtcagtttaaaatga

SEQ ID NO: 2828 - DNA, 3189 bp, Homo sapiens
ggactcgggcagcggcggcgcgcccgacgtggcgcgcgcgaccccttcgtcctgcccctcctcctcgggtcccgtcggcctgcgcgcgcccgggagtttgaatttcctcggatttggagcaatatcgcagtggaaggcgctgtgggttgaggtcgccgcccacctctcctaggggaactatggagctggcagctgaaagactcagtgaagcaacgaggatgccggggagagggaaggggctgggctctgggcggtgccaagtctgtgagggggcgcggtcaccgcccagggttcccacgaacgccaaggcggccacgtcctgctccccctggtgaagaagctgccctgggcttgtcgtcctagggtctccagacatgtctgaggtgaagagccggaagaagtcggggcccaagggagcccctgctgcggagcccgggaagcggagcgagggcgggaagacccccgtggcccggagcagcggaggcgggggctgggcagacccccgaacgtgcctgagcctgctgtcgctggggacgtgcctgggcctggcctggtttgtatttcagcagtcagaaaaatttgcaaaggtggaaaaccaataccagttactgaaactagaaaccaatgaattccaacaacttcaaagtaaaatcagtttaatttcagaaaagcttgagtctactgaaagcatcctgcaggaagctacatcatccatgtctttgatgacccagtttgagcaggaagtatccaacctccaagatatcatgcatgacattcaaaataatgaagaggtgctcactcaaaggatgcaaagccttaatgagaaatttcagaatattacggatttctggaagagaagcctagaagaaatgaacattaatacagacattttcaaatcagaagcaaaacatatacattctcaagtaactgtccaaattaactcagctgagcaggaaataaaattgctcactgaacggctaaaagatttggaagatagcacactaagaaatattagaacagtaaaaagacaagaagaagaagatctcctgcgagtagaggagcagctaggctctgatacaaaggcaattgaaaagttagaagaggaacagcatgccctctttgccagagatgaagatctgactaataaactttccgactacgaacccaaagttgaagaatgcaagacacatttgccaacaattgaaagtgctattcactctgttctcagagtctctcaggatctgatagaaacagaaaagaaaatggaagacttgactatgcagatgtttaatatggaagatgatatgctgaaagcagtgtctgaaataatggagatgcagaaaacccttgaaggaattcagtatgataatagcatattaaagatgcaaaatgaactggatattctaaaagaaaaagttcatgattttatagcatactcaagtacaggagaaaagggaactttaaaagaatataatatagaaaataaaggaattggtggtgatttttaaattcatgacatttattctgatgaaccatatcattatacataaattgattagtccattgattttgagttactttgatacgcctcatcttatcctacattattggaaaataaatgagatgtccacacaaatggattatccacataatcaaagcttatctttttaagcactaaaacttacttcattgtaactatttgaaatagaaatagttctttaaaaatatttctctacttttaaaacaagatacttaatatttttaatgttttttaaagcattaatgaacatcatcattaatttcacctattatattgtacccacatatattgatgtctccaggggctaataaagagtatttaccacttcactaaatgaccccaatttgccattttcaaacctatgtctcataccttttctgtcacctgaacttactgtcaggttggttggtaatgtgcctgcctcagccagttcactttcttaggtaattcactgcaggttaagaatccacacaaccaagttcatgggaattttgtgtaaaataaaagataacatgcctgagggagagcctggtgcctttgctatgaattaatatgcactttctgaaaactctaaagcctgggaaacattttagtttttgttaaggttctaaactgtgttacagatacttgtaagacttttaaaatcagagtaagtatgttcttacataaggcctttcttaggaattatgtgtatataaatctttgaaatatctttatatacctgagttttaggttccaactgtgttagacatgagtttgctagatccatggtctctagatggtttacttaaataggccaggcgcagtggctcacacctgtaatcctagcactttgggaggccgaggtgggcagatcacgaagtcaggagatcaagaccatctggctaacagggtgaaaccctgtctctactaaaaaatacaaaaaattagccaggcgtggtggtgggtgcctgtagtcccagctactcaggaggctgaggcaggagaatggtgtgaacccgggaggcagagcttgcagtgagccgagatcgcgccactgcactccagcctgagtggcaaagtgagactctgtctcaataaataaataaataaataaaaataagcctgtggcctgttttgagggaaaagtaacataactctgataattaattatgataataactatgatagttaaaaatacgtcattttaaagatttcccaaaccacaccactaaatttgttttatgaattgattttattttatttgaaattatataatgtagtcaactgcaatatggaagtttgttcttgtttctttgtcaataaccttaccagttttataatgcagtttttgatggaattaaacacaaagaacttgaaagcagtcagttacaaaaaggtagttgtggtcaagtagttttaatatgtaaatttgcaagtttttggagaacccccaaactccttctccactggagttaggagggcctgtggtagacagcgtgaatcatgaaaataagcctggagagttctgttattaaggggcatagcattaatttttgcagtcttaaaattacacttcttgacttctgaatgtctcttatttgcgtgcactgacaaaattctatttgtttacttttatattaatggtaataaaatagattataaagtaa

SEQ ID NO: 2829 - DNA, 1645 bp, Homo sapiens
gctaagcctcagggacgcgccgcgttcccaccaatgccggactcgggcagcggcggcgcgcccgacgtggcgcgcgcgaccccttcgtcctgcccctcctcctcgggtcccgtcggcctgcgcgcgcccgggagtttgaatttcctcggatttggagcaatatcgcagtggaaggcgctgtgggttgaggtcgccgcccacctctcctaggggaactatggagctggcagctgaaagactcagtgaagcaacgaggatgccggggagagggaaggggctgggctctgggcggtgccaagtctgtgagggggcgcggtcaccgcccagggttcccacgaacgccaaggcggccacgtcctgctccccctggtgaagaagctgccctgggcttgtcgtcctagggtctccagacatgtctgaggtgaagagccggaagaagtcggggcccaagggagcccctgctgcggagcccgggaagcggagcgagggcgggaagacccccgtggcccggagcagcggaggcgggggctgggcagacccccgaacgtgcctgagcctgctgtcgctggggacgtgcctgggcctggcctggtttgtatttcagcagtcagaaaaatttgcaaaggtggaaaaccaataccagttactgaaactagaaaccaatgaattccaacaacttcaaagtaaaatcagtttaatttcagaaaagtggcagaaatctgaagctatcatggaacaattgaagtcttttcaaataattgctcatctaaagcgtctacaggaagaaattaatgaggtaaaaacttggtccaataggataactgaaaaacaggatatactgaacaacagtctgacgacgctttctcaagacattacaaaagtagaccaaagtacaacttccatggcaaaagatgttggtctcaagattacaagtgtaaaaacagatatacgacggatttcaggtttagtaactgatgtaatatcattgacagattctgtgcaagaactagaaaataaaatagagaaagtagaaaaaaatacagtaaaaaatataggtgatcttctttcaagcagtattgatcgaacagcaacgctccgaaagacagcatctgaaaattcacaaagaattaactctgttaagaagacgctaaccgaactaaagagtgacttcgacaaacatacagatagatttctaagcttagaaggtgacagagccaaagttctgaagacagtgacttttgcaaatgatctaaaaccaaaggtgtataatctaaagaaggacttttcccgtttagaaccattagtaaatgatttaacactacgcattgggagattggttaccgacttactacaaagagagaaagaaattgctttcttaagtgaaaaaatatctaatttaacaatagtccaagctgagattaaggatattaaagatgaaatagcacacatttcagatatgaattagtttgacattattgagattagactaaggtaatttttttaatgggacctctcatgagaagactggtaaatcaaaaataatgatattttggagcaaaagtcattttatatttaatcctattttgtacagtaaaaataaaactttaaaacaggttgattttccaaaataaatatgctaaaacct

SEQ ID NO: 2830 - DNA, 1368 bp, Homo sapiens
atatcgcagtggaaggcgctgtgggttgaggtcgccgcccacctctcctaggggaactatggagctggcagctgaaagactcagtgaagcaacgaggatgccggggagagggaaggggctgggctctgggcggtgccaagtctgtgagggggcgcggtcaccgcccagggttcccacgaacgccaaggcggccacgtcctgctccccctggtgaagaagctgccctgggcttgtcgtcctagggtctccagacatgtctgaggtgaagagccggaagaagtcggggcccaagggagcccctgctgcggagcccgggaagcggagcgagggcgggaagacccccgtggcccggagcagcggaggcgggggctgggcagacccccgaacgtgcctgagcctgctgtcgctggggacgtgcctgggcctggcctgtggcagaaatctgaagctatcatggaacaattgaagtcttttcaaataattgctcatctaaagcgtctacaggaagaaattaatgaggtaaaaacttggtccaataggataactgaaaaacaggatatactgaacaacagtctgacgacgctttctcaagacattacaaaagtagaccaaagtacaacttccatggcaaaagatgttggtctcaagattacaagtgtaaaaacagatatacgacggatttcaggtttagtaactgatgtaatatcattgacagattctgtgcaagaactagaaaataaaatagagaaagtagaaaaaaatacagtaaaaaatataggtgatcttctttcaagcagtattgatcgaacagcaacgctccgaaagacagcatctgaaaattcacaaagaattaactctgttaagaagacgctaaccgaactaaagagtgacttcgacaaacatacagatagatttctaagcttagaaggtgacagagccaaagttctgaagacagtgacttttgcaaatgatctaaaaccaaaggtgtataatctaaagaaggacttttcccgtttagaaccattagtaaatgatttaacactacgcattgggagattggttaccgacttactacaaagagagaaagaaattgctttcttaagtgaaaaaatatctaatttaacaatagtccaagctgagattaaggatattaaagatgaaatagcacacatttcagatatgaattagtttgacattattgagattagactaaggtaatttttttaatgggacctctcatgagaagactggtaaatcaaaaataatgatattttggagcaaaagtcattttatatttaatcctattttgtacagtaaaaataaaactttaaaacaggttgattttccaaaataaatatgctaaaacct

SEQ ID NO: 2831 - DNA, 1368 bp, Homo sapiens; identical to SEQ ID NO: 2830

SEQ ID NO: 2832 - DNA, 4479 bp, Homo sapiens
agcggtgcgagtgtggagcgcgcaccccgggcgaggctgacagatcgcccgggtgggtgcaagatggcgcaagcggcgctccccctgcgccccccgcgctgctgagcaggcatgcggccccagtcccccaccgcctgggctcggccccggccggagccccagccccggccccggcgccggccccgcgggacgctgtgagccgcgagaggcccgggagccgcgcgtcgccgagccgagctgaccgagagccccatggctgtgcagcgcgccgcgtctccgcgccgcccgcccgccccgctctggccccggctcctgctgccgctgctgttgctgctgctgcccgcgccgagcgagggtcttggccactctgctgaactggcatttgctgtggagccaagtgatgatgttgccgtccccgggcagcctatagtgctggactgcagggtggaggggacccctccagtgcgaatcacctggaggaagaatggggtagagctgccagagagtacccactccaccttgctggccaatgggtccttgatgatccgtcacttcaggctggagccgggaggcagcccttcggatgaaggtgactatgagtgtgtggcccagaaccgctttgggctggtggtcagccggaaggctcgcatccaagctgcaaccatgtcggacttccacgtgcatccccaggccaccgtgggtgaggagggtggtgtggcccgcttccagtgccaaatccatgggcttcccaaacccctgatcacttgggagaagaacagagtcccaattgacacggacaatgagaggtacacattgctgcccaagggggtcctgcagatcacaggacttcgagctgaggacggtggcatcttccactgtgtggcctcaaacatcgccagtatccggatcagccacggggccaggctcactgtgtcaggctcgggctctggggcctacaaggagccagccatcctcgtggggcctgagaacctcaccctgacagtgcaccagaccgcggtgcttgagtgtgtcgccacgggcaacccgcgccccattgtgtcctggagccgcctggatggtcgccctatcggggtggagggcatccaggtgctgggcacaggaaacctcatcatctcagacgtgacggtccagcactctggcgtctacgtctgtgcagccaacagacctggcacccgggtgaggagaacggcacagggccggctggtggtgcaagccccagctgagtttgtgcagcatccccagtccatctccaggccagctgggaccacagccatgttcacctgccaagcccagggtgagccaccgcctcatgtcacgtggctgaaaaatggacaggtgctggggccaggaggccacgtcaggctcaagaataacaacagcacactgaccatttctggaatcggtcctgaggatgaagccatttatcagtgtgtggccgagaacagtgcgggctcatcacaggccagtgccaggctgaccgtactgtgggctgaggggctccccgggcctccccgcaatgtgcgggcagtctctgtgtcttccactgaggtgcgtgtgtcctggagtgagccgctggccaacaccaaggagatcatcggctacgtcctgcacatcaggaaggctgctgacccaccggagctggagtatcaggaggcagtcagcaagagcacctttcagcacctggtcagcgacctggagccctccacagcctacagtttctacatcaaggcctacacaccaaggggggccagctcagcctctgtgcccaccctagctagcaccctgggtgaagcccctgccccacccccactgtcagtgcgagtcctgggcagctcctccttgcagctgctgtgggagccttggccccggctggcccagcacgagggcggcttcaagctgttttaccgcccagcaagcaagacctccttcaccggccccatcctgctgcctggaaccgtctcctcctacaacctcagccagctcgaccccactgcagtgtatgaggtgaagctgctcgcctacaaccagcatggagatggcaatgccacagtccgctttgtgtctttgaggggagcatctgagaggacagccttgagcccaccatgtgactgccggaaggaggaggccgccaaccagacgtccaccacaggcatcgtcatcggcatccacatcggggtcacttgcatcatcttctgtgtcctcttcctcctgttcggccaaaggggcagggtcctcctgtgtaaagatgtggaaaaccagctgtcccctccacagggtccccggagccagagggaccctggcattctagccctaaatggggcgagacggggacagcggggccagctgggccgagacgagaaacgtgtggatatgaaggagctggagcagctgttccccccggccagcgcagcagggcagccggaccccagacccacacaggatcctgcagcccccgctccgtgtgaggagacccagctctccgtgctgccacttcaggggtgcggcctgatggaggggaagacgacggaggcgaagaccacagaggccacggctccctgcgccggcctggcggctgccccaccacccccagatggaggccctggcctcctcagtgaaggccaggcttccaggcctgcagcggcccgggttacccagccagctcactcggaacagtagccagtgtctggcaggctccagagggtggacggagcggggcccattctcaggtcaaaagcaagatttctactgtcatgtgggatttggatggtcctgggggctccccagcatttctatcctgactgcctcttgggttgtcaaaacccaaggcagccttgacagggaccccccggccctaacacccatcaggagttggagcagttcctgcaggagcctgttccttccctgggctgacgcccccttgcctctgcctggtacccacatgacttggaactgaactaacatttttctttaaaaagcaaaacttaaaaaaaaaaaaaaagaggagagagatagaggaaggtgaattagactccaaaagatgaccctgctgtagctgggccctgacactgtcaccctccaccgactttgttttctcaggatggatttttgctgttttggctctcagcacctacctcagccggaatgaatgtcctggggggcagtggggcggtggcctcagcccccttaccccacagagcccgaatgcactcctacctcaagtccccttgctggggaccccctctcccttcccacactgttgtccagagtaaaaaaaaaaaaaaaaaaaaaagcacttccccgtttccaggtgtgaaagaaaaaaaaaagcacttccccatttccagatgtgaaagaaaatgtctacctcaaggctcgctggctctgtgggctgtgttgtcactggacctgcctccccgcccctcctgcccacagcccacctacctctcctgcagaggagaggccagaggttgggccaccaaggggaactcttgtggcctacagaaatagaaatggattgggcagagaaaaaatgtgaaagcagccaaaaatgagaggaaatttgttccttgaagtataaattgtccaaacgagccacctcccagcacaccgcctgtccccgtcttgtctgtccactcccattttgagccagcccatccttgatggggatgcccatgaggaacctgggcttgggagggtggcatcagctggccgcctgcctcctgtcctgcaggcccggcccctggaatgtaccatgtgtgggatgggtgtgtgggagggtgagggggtgtgggtgtcccctgcagaggcgccccagcctcaggcacccagccagcctgatccacccctcgacaggggagcatccactgtcagcagccatggccggaagctatttttatacaaggtgtgttaagggttatgttcttgtgactttttgttactcttttctgttgtgttgttctttgaactacttagttaaagaagaagaaaagaaaaccaaggaaacaaatacctatttttggttatactcagaaacatttttttaaatagcagaagaaaaactttttttaaagaaaaaagataagtgtattccttaagaatgagaccataaatatccctgacccccaatcctctagggacacctccaccctgaactttagttaattagctgaagaagatagaatttgtggtgttttcctagaaaactagagctgtgtccgcgtggacttggggaagggtagtcccttcccttctcccaaatgatgtgtggatgcccagggctccacaaagctccaaggcagtgccccctctgttcccaaagcagcttctctcgggagcctccctctcccttgggaagggtgcggctggggcaggagggggctggggggccacctggccttacttgggttttgtcacactctgctcattttgactgaataaaagtcctgttgccaaagtgaa

SEQ ID NO: 2833 - DNA, 2577 bp, Homo sapiens
agcggtgcgagtgtggagcgcgcaccccgggcgaggctgacagatcgcccgggtgggtgcaagatggcgcaagcggcgctccccctgcgccccccgcgctgctgagcaggcatgcggccccagtcccccaccgcctgggctcggccccggccggagccccagccccggccccggcgccggccccgcgggacgctgtgagccgcgagaggcccgggagccgcgcgtcgccgagccgagctgaccgagagccccatggctgtgcagcgcgccgcgtctccgcgccgcccgcccgccccgctctggccccggctcctgctgccgctgctgttgctgctgctgcccgcgccgagcgagggtcttggccactctgctgaactggcatttgctgtggagccaagtgatgatgttgccgtccccgggcagcctatagtgctggactgcagggtggaggggacccctccagtgcgaatcacctggaggaagaatggggtagagctgccagagagtacccactccaccttgctggccaatgggtccttgatgatccgtcacttcaggctggagccgggaggcagcccttcggatgaaggtgactatgagtgtgtggcccagaaccgctttgggctggtggtcagccggaaggctcgcatccaagctgcaaccatgtcggacttccacgtgcatccccaggccaccgtgggtgaggagggtggtgtggcccgcttccagtgccaaatccatgggcttcccaaacccctgatcacttgggagaagaacagagtcccaattgacacggacaatgagaggtacacattgctgcccaagggggtcctgcagatcacaggacttcgagctgaggacggtggcatcttccactgtgtggcctcaaacatcgccagtatccggatcagccacggggccaggctcactgtgtcaggctcgggctctggggcctacaaggagccagccatcctcgtggggcctgagaacctcaccctgacagtgcaccagaccgcggtgcttgagtgtgtcgccacgggcaacccgcgccccattgtgtcctggagccgcctggatggtcgccctatcggggtggagggcatccaggtgctgggcacaggaaacctcatcatctcagacgtgacggtccagcactctggcgtctacgtctgtgcagccaacagacctggcacccgggtgaggagaacggcacagggccggctggtggtgcaagccccagctgagtttgtgcagcatccccagtccatctccaggccagctgggaccacagccatgttcacctgccaagcccagggtgagccaccgcctcatgtcacgtggctgaaaaatggacaggtgctggggccaggaggccacgtcaggctcaagaataacaacagcacactgaccatttctggaatcggtcctgaggatgaagccatttatcagtgtgtggccgagaacagtgcgggctcatcacaggccagtgccaggctgaccgtactgtgggctgaggggctccccgggcctccccgcaatgtgcgggcagtctctgtgtcttccactgaggtgcgtgtgtcctggagtgagccgctggccaacaccaaggagatcatcggctacgtcctgcacatcaggaaggctgctgacccaccggagctggagtatcaggaggcagtcagcaagagcacctttcagcacctggtcagcgacctggagccctccacagcctacagtttctacatcaaggcctacacaccaaggggggccagctcagcctctgtgcccaccctagctagcaccctgggtgaagcccctgccccacccccactgtcagtgcgagtcctgggcagctcctccttgcagctgctgtgggagccttggccccggctggcccagcacgagggcggcttcaagctgttttaccgcccagcaagcaagacctccttcaccggccccatcctgctgcctggaaccgtctcctcctacaacctcagccagctcgaccccactgcagtgtatgaggtgaagctgctcgcctacaaccagcatggagatggcaatgccacagtccgctttgtgtctttgaggggagcatctgagaggacagccttgagcccaccatgtgactgccggaaggaggaggccgccaaccagacgtccaccacaggcatcgtcatcggcatccacatcggggtcacttgcatcatcttctgtgtcctcttcctcctgttcggccaaaggggcagggtcctcctgtgtaaagatgtggatatgaaggagctggagcagctgttccccccggccagcgcagcagggcagccggaccccagacccacagatcctgcagcccccgctccgtgtgaggagacccagctctccgtgctgccacttcaggggtgcggcctgatggaggggaagacgacggaggcgaagaccacagaggccacggctccctgcgccggcctggcggctgccccaccacccccagatggaggccctggcctcctcagtgaaggccaggcttccaggcctgcagcggcccgggttacccagccagctcactcggaacagtag

SEQ ID NO: 2834 - DNA, 6508 bp, Homo sapiens
ctcgcccaagatggcgatggaggggcgggtgaggcggcagcggccctggcccccgcgccggccccagctcgggcccgggcccccgaggccgcgcccccgcccgcggcgccgcgcctccccgggccactgacgcccggcgcgctctccccccgcggcggcggccgaagcacggggaggcggcggcggcggcggcggcccgagcccagccccatggcgcggggggacgccggccgcggccgcgggctcctcgcgttgaccttctgcctgttggccgcgcgcggggagctgctgttgccccaggagacgactgtggagctgagctgtggagtggggccactgcaagtgatcctgggcccagagcaggctgcagtgctaaactgtagcctgggggctgctgccgctggaccccccaccagggtgacctggagcaaggatggggacaccctgctggagcacgaccacttacacctgctgcccaatggttccctgtggctgtcccagccactagcacccaatggcagtgacgagtcagtccctgaggctgtgggggtcattgaaggcaactattcgtgcctagcccacggccccctcggagtgctggccagccagactgctgtcgtcaagcttgccacactcgcagacttctctctgcacccggagtctcagacggtggaggagaacgggacagctcgctttgagtgccacattgaagggctgccagctcccatcattacttgggagaaggaccaggtgacattgcctgaggagcctcggctcatcgtgcttcccaacggcgtccttcagatcctggatgttcaggagagtgatgcaggcccctaccgctgcgtggccaccaactcagctcgccagcacttcagccaggaggccctactcagtgtggcccacagagggtccctggcgtccaccagggggcaggacgtggtcattgtggcagccccagagaacaccacagtggtgtctggccagagtgtggtgatggaatgtgtggcctcagctgaccccaccccttttgtgtcctgggtccgacaagacgggaagcccatctccacagatgtcatcgtcctgggccgcaccaacctactaattgccaacgcgcagccctggcactccggcgtctatgtctgccgcgccaacaagccccgcacgcgcgacttcgccactgcagccgctgagctccgtgtgctggcggctcccgccatcactcaggcgcccgaggcgctgtcgcggacgcgggcgagcacagcgcgcttcgtgtgccgcgcgtcgggggagccgcggccagcgctgcgctggctgcacaacggggcgccgctgcggcccaacgggcgcgtcaaggtccagggcggcggtggcagcctggtcatcacacagatcggcctgcaggacgccggctactaccagtgcgtggctgagaacagcgcgggaatggcgtgcgctgccgcgtcgctggccgtggtggtgcgcgaggggctgcccagcgcccccacgcgggtcactgctacgccactgagcagctccgctgtgttggtggcctgggagcggcccgagatgcacagcgagcagatcatcggcttctctctccactaccagaaggcacggggcatggacaatgtggaataccagtttgcagtgaacaacgacaccacagaactacaggttcgggacctggaacccaacacagattatgagttctacgtggtggcctactcccagctgggagccagccgcacctccaccccagcactggtgcacacactggatgatgtccccagtgcagcaccccagctctccctgtccagccccaacccttcggacatcagggtggcgtggctgcccctgccccccagcctgagcaatgggcaggtggtgaagtacaagatagaatacggtttgggaaaggaagatcagattttctctactgaggtgcgaggaaatgagacacagcttatgctgaactcgcttcagccaaacaaggtgtatcgagtacggatttcggctggtacagcagccggcttcggggccccctcccagtggatgcatcacaggacgcccagtatgcacaaccagagccatgtcccttttgcccctgcagagttgaaggtgcaggcaaagatggagtccctggtcgtgtcatggcagccaccccctcaccccacccagatctctggctacaaactatattggcgggaggtgggggctgaggaggaggccaatggcgatcgcctgccagggggccgtggagaccaggcttgggatgtggggcctgtccggctcaagaagaaagtgaagcagtatgagctgacccagctagtccctggccggctgtacgaggtgaagctcgtggctttcaacaaacatgaggatggctatgcagcagtgtggaagggcaagacggagaaggcgccggcaccagacatgcctatccagaggggaccacccctgcctccagcccacgtccatgcggaatcaaacagctccacatccatctggcttcggtggaaaaagccagatttcaccacagtcaagattgtcaactacactgtgcgcttcagcccctgggggctcaggaatgcctccctggtcacctattacaccagttctggagaagacatcctcattggcggcttgaagccattcaccaaatacgagtttgcagtgcagtctcacggcgtggacatggatgggcctttcggctctgtggtggagcgctccaccctgcctgaccggccctccacacccccatccgacctgcgactgagccccctgacaccgtccacggttcggctgcactggtgcccccccacagagcccaacggggagatcgtggagtatctgatcctgtacagcagcaaccacacgcagcctgagcaccagtggaccttgctcaccacgcagggaaacatcttcagtgctgaggtccatggcctggagagcgacactcggtacttcttcaagatgggggcgcgcacagaggtgggacctgggcctttctcccgcctgcaggatgtgatcacgctccaggagaagctgtcagactcgctggacatgcactcagtcacgggcatcatcgtgggtgtctgcctgggcctcctctgcctcctggcctgcatgtgtgctggcctgcgccgcagcccccacagggaatccctcccaggcctgtcctccaccgccacccccgggaatcccgcgctgtactccagagctcggcttggcccccccagccccccagctgcccatgaattggagtcccttgtgcacccccatccccaggactggtccccgccaccctcagacgtggaggacagggctgaagtgcacagccttatgggtggcggtgtttctgaaggccggagtcactccaaaagaaagatctcctgggctcaaccaagcgggctgagctgggctggttcctgggcaggctgtgagctgccccaggcaggcccccggccggctctgacccgggccctgctgccccctgctggaactgggcagacgctgttgctgcaggctctggtgtacgacgccataaagggcaatgggaggaagaagtcacccccagcctgcaggaaccaggtggaggctgaagtcattgtccactctgactttagtgcatctaacgggaaccctgacctccatctccaagacctggagcctgaggaccccctgcctccagaggctcctgatctcatctcgggtgttggggatccagggcagggggcagcctggctggacagggagttgggagggtgtgagctggcagcccccgggccagacagacttacctgcttgccagaggcagccagtgcttcctgctcctacccggacctccagccaggcgaggtgctagaggagacccctggagatagctgccagctcaaatccccctgccctctaggagccagcccaggcctgcccagatccccggtctcctcctctgcctagctcttcccagaggatgtggtttggggcaggcaggtatggatcacataggatgcgatacctgtggccgtgtatgtccacatgtgtgcctgtagatacatcatcaagccctttggagcttcctaagttgctttggctgaggggagaggaaaacatggattattcactccccccatactctttgtgatacacatgtgacatgtgaaagacatacgagacatagctacatgtgatgtgcacatgtgtgaagtgcatgtatgcgtactggttgttgagctgggaaaccgtggcccaggcagtggtcactacagcctgattggtcctccaggtcagaacggtgccccacagtggtcagtccccagccctgtgggcccccacctccatcgcccagccttttattacacactctgagagtgtctccaatgcctgtctgacaaagacagtcccagcccattctcctgtctggctgggttgggtgcaagcaggctctgaatgcctggcatttcagctgcatcacctcccagctccttattgcccaaatagagagggtggccctggctcccctccgagcaactctgcatttaattttgtaatctgggaagtgcctggttttgaaaatccgctttctctcactcttcccctccttccttgcccctggctgctctagtgttctgtctcccagtcacctcgctctcccagcaccagtgcccttctcctgctcccagatactctttcctttcctctctcctgttttccttcctctgctatctctcacacctctcccagactatgtcatcttgttctcctgcctgggttcaaactctgcatccttctctaacaacgtgactacctcatgtctgcttcaaggcccccgtgcccttcctgtatccgcggctgccgcgcactcgcctgccatcctcctgcctcctcttcactcagtgcttctgcttgccctgccccaggcagcccacccacgcccagtgcgggtgtggagaagatcttctggcttccctgcatcttgcctttgggattgggatccaagggttctccatggatggatccaagtcatagaggggaatgtttgagacagggaagggggctgtgatccagaggctcagaataaaaagatgccctcccttctatgcaggggggcaagtttactggatggagatgatttgggcctctcttccagaagaagctaaaggaagagaaggggagtgagagttcagggaggcccttcccaccctgtgaggcttgacttgatctggattggggatgacaggaatctcaccctctggggtgctggcaaggaggtctttgcacaggaaaaggggtagctcatttcagtttgttttttctttaaattgaatcctcaagtcattttctgttcacctgccgcacagggacaagcttgacttctattttctgtgtagtgaaaacaatgtcatttatttggtttttcacctcagccctctcataggagcatagaatgttagggtctttactccctaatgatgtctgattggcacatcaagagttaactctgccttctgggccaaattcgaaataaccagtccatttttccttttttttttttttttttttaaatggtggaatgtctctcagcacagttgcggcttcctcaaaccctgaaagcatctgtgtttattatactcgggtgtcactcactgttgatgtctgcacctacgtttccacctcctccccctccttcagccagcctatgataacactaaagattattaatgttggttttgtatctcgttaaagacagaattgtcacttgtagtatttctgtagcattcagcgctgctgtggctaacaccactgtgtatgtttcatcattgctctgaaggtcaaaagcctcattttattttgctggtttgattttttttttttaaagaagaaaaaaaaactgccctgaattaaatggctgttttaacagtaggctcttagcattataccacatagtcatttttcatgttcttgtttaacaggcactgaggttctggtttaaattaaatagctgcaaatgagacaatttataacccattaggttgggtggaaaattgtttctcaaaagcaaataagtaataaatctggtatctgcctataactcacagttgataagaaagtggccatttctcactagcactatatatgatttgggctctgggtaatttggaagtgttaggtttgtgtctttgtagcagtatttttattagaaaagaatctattggccttttacagggtattaatccctttgtcacctaccattgatgccttaagttttctgagtctcaattaaaaatcttccttttcttgatgcatgacaagtgtaatcagtacttgctcatttatttgtctgtatttagtttatgctgtactatttaattatccttccagcgttttttttttctccttacaaatatgatactctttagtgttaagctaaggcattgattcatgtatctgtccttataatgaattaataaactattttccagaaatgtggaattctcttttggaa

SEQ ID NO: 2835 - DNA, 5462 bp, Homo sapiens
atggggagaagaaagggtaggtctgcgctgagccggagtagtttggaaagggtgaatcagggagaggttaaagtgattggaaggggagcgagggagggcggtggggggcaggcttggggtactgggggggggagagaccttagttgcgggatcccgcgctcagcgtcgcccctcgcgcccctagcggctcccgccatcactcaggcgcccgaggcgctgtcgcggacgcgggcgagcacagcgcgcttcgtgtgccgcgcgtcgggggagccgcggccagcgctgcgctggctgcacaacggggcgccgctgcggcccaacgggcgcgtcaaggtccagggcggcggtggcagcctggtcatcacacagatcggcctgcaggacgccggctactaccagtgcgtggctgagaacagcgcgggaatggcgtgcgctgccgcgtcgctggccgtggtggtgcgcgaggggctgcccagcgcccccacgcgggtcactgctacgccactgagcagctccgctgtgttggtggcctgggagcggcccgagatgcacagcgagcagatcatcggcttctctctccactaccagaaggcacggggcatggacaatgtggaataccagtttgcagtgaacaacgacaccacagaactacaggttcgggacctggaacccaacacagattatgagttctacgtggtggcctactcccagctgggagccagccgcacctccaccccagcactggtgcacacactggatgatgtccccagtgcagcaccccagctctccctgtccagccccaacccttcggacatcagggtggcgtggctgcccctgccccccagcctgagcaatgggcaggtggtgaagtacaagatagaatacggtttgggaaaggaagatcagattttctctactgaggtgcgaggaaatgagacacagcttatgctgaactcgcttcagccaaacaaggtgtatcgagtacggatttcggctggtacagcagccggcttcggggccccctcccagtggatgcatcacaggacgcccagtatgcacaaccagagccatgtcccttttgcccctgcagagttgaaggtgcaggcaaagatggagtccctggtcgtgtcatggcagccaccccctcaccccacccagatctctggctacaaactatattggcgggaggtgggggctgaggaggaggccaatggcgatcgcctgccagggggccgtggagaccaggcttgggatgtggggcctgtccggctcaagaagaaagtgaagcagtatgagctgacccagctagtccctggccggctgtacgaggtgaagctcgtggctttcaacaaacatgaggatggctatgcagcagtgtggaagggcaagacggagaaggcgccggcaccagacatgcctatccagaggggaccacccctgcctccagcccacgtccatgcggaatcaaacagctccacatccatctggcttcggtggaaaaagccagatttcaccacagtcaagattgtcaactacactgtgcgcttcagcccctgggggctcaggaatgcctccctggtcacctattacaccagttctggagaagacatcctcattggcggcttgaagccattcaccaaatacgagtttgcagtgcagtctcacggcgtggacatggatgggcctttcggctctgtggtggagcgctccaccctgcctgaccggccctccacacccccatccgacctgcgactgagccccctgacaccgtccacggttcggctgcactggtgcccccccacagagcccaacggggagatcgtggagtatctgatcctgtacagcagcaaccacacgcagcctgagcaccagtggaccttgctcaccacgcagggaaacatcttcagtgctgaggtccatggcctggagagcgacactcggtacttcttcaagatgggggcgcgcacagaggtgggacctgggcctttctcccgcctgcaggatgtgatcacgctccaggagaagctgtcagactcgctggacatgcactcagtcacgggcatcatcgtgggtgtctgcctgggcctcctctgcctcctggcctgcatgtgtgctggcctgcgccgcagcccccacagggaatccctcccaggcctgtcctccaccgccacccccgggaatcccgcgctgtactccagagctcggcttggcccccccagccccccagctgcccatgaattggagtcccttgtgcacccccatccccaggactggtccccgccaccctcagacgtggaggacagggctgaagtgcacagccttatgggtggcggtgtttctgaaggccggagtcactccaaaagaaagatctcctgggctcaaccaagcgggctgagctgggctggttcctgggcaggctgtgagctgccccaggcaggcccccggccggctctgacccgggccctgctgccccctgctggaactgggcagacgctgttgctgcaggctctggtgtacgacgccataaagggcaatgggaggaagaagtcacccccagcctgcaggaaccaggtggaggctgaagtcattgtccactctgactttagtgcatctaacgggaaccctgacctccatctccaagacctggagcctgaggaccccctgcctccagaggctcctgatctcatctcgggtgttggggatccagggcagggggcagcctggctggacagggagttgggagggtgtgagctggcagcccccgggccagacagacttacctgcttgccagaggcagccagtgcttcctgctcctacccggacctccagccaggcgaggtgctagaggagacccctggagatagctgccagctcaaatccccctgccctctaggagccagcccaggcctgcccagatccccggtctcctcctctgcctagctcttcccagaggatgtggtttggggcaggcaggtatggatcacataggatgcgatacctgtggccgtgtatgtccacatgtgtgcctgtagatacatcatcaagccctttggagcttcctaagttgctttggctgaggggagaggaaaacatggattattcactccccccatactctttgtgatacacatgtgacatgtgaaagacatacgagacatagctacatgtgatgtgcacatgtgtgaagtgcatgtatgcgtactggttgttgagctgggaaaccgtggcccaggcagtggtcactacagcctgattggtcctccaggtcagaacggtgccccacagtggtcagtccccagccctgtgggcccccacctccatcgcccagccttttattacacactctgagagtgtctccaatgcctgtctgacaaagacagtcccagcccattctcctgtctggctgggttgggtgcaagcaggctctgaatgcctggcatttcagctgcatcacctcccagctccttattgcccaaatagagagggtggccctggctcccctccgagcaactctgcatttaattttgtaatctgggaagtgcctggttttgaaaatccgctttctctcactcttcccctccttccttgcccctggctgctctagtgttctgtctcccagtcacctcgctctcccagcaccagtgcccttctcctgctcccagatactctttcctttcctctctcctgttttccttcctctgctatctctcacacctctcccagactatgtcatcttgttctcctgcctgggttcaaactctgcatccttctctaacaacgtgactacctcatgtctgcttcaaggcccccgtgcccttcctgtatccgcggctgccgcgcactcgcctgccatcctcctgcctcctcttcactcagtgcttctgcttgccctgccccaggcagcccacccacgcccagtgcgggtgtggagaagatcttctggcttccctgcatcttgcctttgggattgggatccaagggttctccatggatggatccaagtcatagaggggaatgtttgagacagggaagggggctgtgatccagaggctcagaataaaaagatgccctcccttctatgcaggggggcaagtttactggatggagatgatttgggcctctcttccagaagaagctaaaggaagagaaggggagtgagagttcagggaggcccttcccaccctgtgaggcttgacttgatctggattggggatgacaggaatctcaccctctggggtgctggcaaggaggtctttgcacaggaaaaggggtagctcatttcagtttgttttttctttaaattgaatcctcaagtcattttctgttcacctgccgcacagggacaagcttgacttctattttctgtgtagtgaaaacaatgtcatttatttggtttttcacctcagccctctcataggagcatagaatgttagggtctttactccctaatgatgtctgattggcacatcaagagttaactctgccttctgggccaaattcgaaataaccagtccatttttccttttttttttttttttttttaaatggtggaatgtctctcagcacagttgcggcttcctcaaaccctgaaagcatctgtgtttattatactcgggtgtcactcactgttgatgtctgcacctacgtttccacctcctccccctccttcagccagcctatgataacactaaagattattaatgttggttttgtatctcgttaaagacagaattgtcacttgtagtatttctgtagcattcagcgctgctgtggctaacaccactgtgtatgtttcatcattgctctgaaggtcaaaagcctcattttattttgctggtttgattttttttttttaaagaagaaaaaaaaactgccctgaattaaatggctgttttaacagtaggctcttagcattataccacatagtcatttttcatgttcttgtttaacaggcactgaggttctggtttaaattaaatagctgcaaatgagacaatttataacccattaggttgggtggaaaattgtttctcaaaagcaaataagtaataaatctggtatctgcctataactcacagttgataagaaagtggccatttctcactagcactatatatgatttgggctctgggtaatttggaagtgttaggtttgtgtctttgtagcagtatttttattagaaaagaatctattggccttttacagggtattaatccctttgtcacctaccattgatgccttaagttttctgagtctcaattaaaaatcttccttttcttgatgcatgacaagtgtaatcagtacttgctcatttatttgtctgtatttagtttatgctgtactatttaattatccttccagcgttttttttttctccttacaaatatgatactctttagtgttaagctaaggcattgattcatgtatctgtccttataatgaattaataaactattttccag

SEQ ID NO: 2836 - DNA, 3558 bp, Homo sapiens
gccgtcccgctgttgtaagtggagggacggcagtcagctgaccctgcagtgtgcaggcgagcgcagggagtacgccatgtcctgagaaggggcgattctcaggctctggcagttacagcttctcctcaccctgccgagcaaccaggccacggggctccgtgcatcgccacctagagtgttaccctcttccttgttcacagaggttctccgcagtgtgtgagaaagaggccctctctcagatgaatggataaagaaaatgcaggacatatggtgggaggagccaagatggccgaataggaacagctccggtctacagctcccagtgtgagcgacacagaagacaggtgatttctgcatttccatctgaggcaagaagaataaatgtctctggtggaacttttgctctggtggaactgcttttctagaactggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcaccccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggcttttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaatttacaaactcccccactttattttgtgctatgtagatctggccatacttgcattagtgactgtcttgccttaaccacacttaagcaacccacaaatttcttctcagatttgtttcctagattacttatgatactcatcccatgtctcaataagagtgtcttttctttctggatgtgttctcttactccctcttaccaccatactttttgctctcttctcctgcaagcgtagtcttcacagggagtggcttcctgacatttttttcagttatgtgaatgaatggaaaccaacagctgctgcaaacactgtttttccaagaaggctacactcagaacctaaccattgccaaccatttcagtattgataaaaagctgaatttactttagcattacttatttttttttccatttgatggttcttactttgtaaaaatttaaataaatgaatgtctatactttttataaagaaaagtgaaaataccatgacactgaaaagatgatgctatcagatgctgtttagaaagcatttatcttgcatttctttattctttctaattatctaaaattcaataaaattttattcat

SEQ ID NO: 2837 - DNA, 3495 bp, Homo sapiens
agttggggggagtggctccccggactgcgcgaggggtcggctagtcctggggcagggctgggtggcacggctggcgagcccggaacgcctctggtcacagctcagcgtccgcggagccgggcggcgctgcagctgcacttggctcgtctgtgggtctgacagtcccagctctgcgcggggaacagcggcccggcgctgggtgtgggaggaccaggctgccccaagagcgcggagactcacgcccgctcctctcctgttgcgaccgggagccgggtaggaggcaggcgcgctccctgcggccccgggatgacttctcagcgttcccctctggcgcctttgctgctcctctctctgcacggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcaccccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggcttttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaatttacaaactcccccactttattttgtgctatgtagatctggccatacttgcattagtgactgtcttgccttaaccacacttaagcaacccacaaatttcttctcagatttgtttcctagattacttatgatactcatcccatgtctcaataagagtgtcttttctttctggatgtgttctcttactccctcttaccaccatactttttgctctcttctcctgcaagcgtagtcttcacagggagtggcttcctgacatttttttcagttatgtgaatgaatggaaaccaacagctgctgcaaacactgtttttccaagaaggctacactcagaacctaaccattgccaaccatttcagtattgataaaaagctgaatttactttagcattacttatttttttttccatttgatggttcttactttgtaaaaatttaaataaatgaatgtctatactttttataaagaaaagtgaaaataccatgacactgaaaagatgatgctatcagatgctgtttagaaagcatttatcttgcatttctttattctttctaattatctaaaattcaataaaattttattcatataaaataa

SEQ ID NO: 2838 - DNA, 3525 bp, Homo sapiens
gtgcgtcagggagagtggccgtcccgctgttgtaagtggagggacggcagtcagctgaccctgcagtgtgcaggcgagcgcagggagtacgccatgtcctgagaaggggcgattctcaggctctggcagttacagcttctcctcaccctgccgagcaaccaggccacggggctccgtgcatcgccacctagagtgttaccctcttccttgttcacagaggttctccgcagtgtgtgagaaagaggccctctctcaggcaagaagaataaatgtctctggtggaacttttgctctggtggaactgcttttctagaactggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcaccccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggcttttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaatttacaaactcccccactttattttgtgctatgtagatctggccatacttgcattagtgactgtcttgccttaaccacacttaagcaacccacaaatttcttctcagatttgtttcctagattacttatgatactcatcccatgtctcaataagagtgtcttttctttctggatgtgttctcttactccctcttaccaccatactttttgctctcttctcctgcaagcgtagtcttcacagggagtggcttcctgacatttttttcagttatgtgaatgaatggaaaccaacagctgctgcaaacactgtttttccaagaaggctacactcagaacctaaccattgccaaccatttcagtattgataaaaagctgaatttactttagcattacttatttttttttccatttgatggttcttactttgtaaaaatttaaataaatgaatgtctatactttttataaagaaaagtgaaaataccatgacactgaaaagatgatgctatcagatgctgtttagaaagcatttatcttgcatttctttattctttctaattatctaaaattcaataaaattttattcatataaaataagttgtcattaattatcaatactaacgagtatgtcattttaaaacttagtattctctttaatgttacaaga

SEQ ID NO: 2839 - DNA, 989 bp, Homo sapiens
attgtacggtgagagaatgagagcaaaacctcagagcccccttcccaggaaccctgtcccagcctggtccccacccaccaccaccactgacccgatgctagagaaggatgcggctggaggtgacttcccagccaacttggtcctccaactaatgccactgaagacattcccagctgctatccggggagtcatccagagtgagctcaactattctgtgatcctgcagtgggtggtgacaatggaccctgagcctgtgctgagctggaccttcagtggggtgccctgtgggatgggagagaagctgttcatccgacggttgtcctgtgagcagctgggcacctacatgtgcatagccacaaacagcaagaaacagctggtctctgagcctgtaaccatctcgctgccaaaacccatcatgcagcccacagaagcagagcccatggagccagaccccactctgtccctgtcaggaggctctgccatcgggctccttgcggctgggatcctgggagccggggcactgattgcaggcatgtgtttcatcatcatccagagcctaaggactgacaggcagagaataggaatatgcagctgaaatgtgggcaactctcctgtcagctgaagagatgggtgctttgtacctctctatccacgtggaaaaaaaaacccatcccatagcttccaagtctacaacatctctgttcaagggaacaacccaacgtaaccagactccctttgccctgtttctgaaacacctgaagaaaacatctgatgggttgactcggtgccatccttggtcccatcgccgtgacacgttgtgcaagcaaagcatcagaggctcatccctgtctgtgggagctcagtgctcagaaaacaggggggaggttttaccttggaaattggccagaccccaaaatatgtcttttacacatgctgctttttttttctctttttcaaaaagaaccaaaaaataaattaaaacaccacca

SEQ ID NO: 2840 - DNA, 2066 bp, Homo sapiens
accattagtacctaggaggcagggatcagaggaagtagattcagaggtaaggagaattttggggctatactttcaagaaagtcgtgttcgggacccaggaggtatgggtcagaaggaaaggagcacagcagatactctgccggatctggaggaatggaagtcagcggcgggtctgcgatggtggcaaacagcagtggtggacggttctgggtctggtaatgaagtcatagaaggcccccaaaatgcaagagtcctgaagggctcccaggctcgcttcaactgcaccgtctcccagggctggaagctcatcatgtgggctctcagtgacatggtggtgctaagcgtcaggcccatggagcccatcatcaccaatgaccgcttcacctctcagaggtacgaccagggcgggaacttcacctcggagatgatcatccacaatgtggagcccagtgattcggggaacatcagatgcagcctccagaacagtcgcctgcatggatctgcttaccttaccgtccaagttatgggagagctgttcattcccagtgttaatcttgtagtcgctgagaatgaaccttgtgaagttacttgtctaccctcacactggacccggctcccggatatttcctgggagctcggtctcctggtcagccattcaagctattattttgttccggagcccagcgaccttcaaagtgcagtgagcatcctggctctgaccccacagagcaatgggactttgacttgcgtggctacctggaagagcctgaaggcccgcaagtctgcaactgtaaatctcactgtgattcggtgtccccaagacactggaggtggtattaatattccaggtgtattatcaagtttaccgagtttaggtttttcattgcctacttggggcaaagttggacttggactagcaggcaccatgcttctgacgccgacgtgtactcttacaatacgctgctgctgctgccgccgtcgttgttgtggctgcaactgctgctgccgttgttgtttctgctgtagaagaaaaagaggatttcgtattcaatttcaaaagaaatctgaaaaagagaagacaaacaaagaaactgagacagaaagtggaaatgaaaactccggctacaattcagatgaacaaaagaccacagacaccgcttctctccctcccaaatcctgtgaatccagtgatcctgaacaaagaaacagtagctgtggccctcctcaccagcgggctgatcaacgtccacccaggccagcaagtcatccacaggcttcttttaatctggccagtcctgagaaggtcagtaatacaactgtagtatagcaaagccttccccaagctccactgagcacttggctgacaattcaaaacacggcgatggcatccttcctttccatcctaagactggcctgcagctttgccaacattacctgaagaggagatgtcggagtcatcagaactgatacttgacagtgagagaaggaatcgattttcccagagttcaaagtagaatgtgacttttaagaggtttcatggtttttgtgaattccatgaagttactaagtaaaagctgcaaattcatcataatttttctcaacattcaacactcctacttgttaatccaacaaatggtagataaaagtctgtattctaccatgcctttcaaaagtttttattatctgaaagcatatgaagatgatatttatgtatatttaatatgtaggggtattattacatattatcagtgaaatacgagtataaaaattagggtcaaccagaaatctgcaattgactgtcaaaactgagctcagttaaagtaagattcaattctaacatggatgtgcacgttcctaaatatcttatgattgaatatttacatgaaggcattcatttttatctgcccctttatcagacctatttgcatctcctcaaatgaattagatgtggcctatgctttgcagaggatggacctcacctactccgcacaccgtgaaaaaactggaaatgggcattgtagtctttaattaataaaaacaccaaaaatgtgtattgcctttcttaa

SEQ ID NO: 2841 - DNA, 2572 bp, Homo sapiens
gttccagccatttcccactttcctcactccgtaattcggctgggaagttggggaagatggatagggtcttgctgaggtggatttctctcttctggctaacagccatggtcgaaggccttcaggtcacagtgcccgacaagaagaaggtggccatgctcttccagcccactgtgcttcgctgccacttctcaacatcctcccatcagcctgcagttgtgcagtggaagttcaagtcctactgccaggatcgcatgggagaatccttgggcatgtcctctacccgggcccaatctctcagcaagagaaacctggaatgggacccctacttggattgtttggacagcaggaggactgttcgagtagtagcttcaaaacagggctcgactgtcaccctgggagatttctacaggggcagagagatcacgattgttcatgatgcagatcttcaaattggaaagcttatgtggggagacagcggactctattactgtattatcaccaccccagatgacctggaggggaaaaatgaggactcagtggaactgctggtgttgggcaggacagggctgcttgctgatctcttgcccagttttgctgtggagattatgccagagtgggtgtttgttggcctggtgctcctgggcgtcttcctcttcttcgtcctggtggggatctgctggtgccagtgctgccctcacagctgctgctgctatgtccgctgcccatgctgcccagattcctgctgctgccctcaagccttgtatgaagcagggaaagcagcaaaggccgggtaccctccctctgtctccggtgtccccggcccttactccatcccctctgtccctttgggaggagccccctcatctggcatgctgatggacaagccgcatccacctcccttggcaccaagtgactccactggaggaagccacagtgttcgcaaaggttaccggatccaggctgacaaagagagagactccatgaaggtcctgtactatgttgagaaggagctggctcagtttgatccagccagaaggatgagaggcagatataacaacaccatctcagaactcagctccctacatgaggaggacagcaatttccgccagtctttccatcagatgagaagcaagcagttccctgtgtctggggacttggagagcaatcctgactattggtcaggtgtcatgggaggcagcagtggggcaagccgcgggccctcagccatggagtataacaaagaggatcgagagagcttcaggcacagccagccgcgctccaagtcggagatgctgtcgcggaagaacttcgccacgggggtgccggccgtttccatggacgagctggcggccttcgctgactcctacggccagcggccccgccgggcagacggcaacagtcacgaggcgcggggcgggagccgcttcgagcgctcggagtcgcgggcgcacagcggcttctaccaggacgactccttggaggagtactacggtcagcgcagccgcagccgcgagcccctgaccgatgctgaccgcggctgggccttcagccccgcgcgccgcagacccgccgaggacgcgcacctgccgcggctggtgagccgcacgccaggcaccgcacccaaatacgaccactcgtacctgggcagcgcgcgggagcgccaggcgcggcccgagggcgccagccgcggtggcagcctggagacgccatccaagcggagcgcgcagctcggcccgcgcagcgcctcctactacgcttggtcgccgcccggcacctacaaggccggctcgtcgcaggacgaccaggaggacgcgtccgacgacgcgctgccgccctacagcgagctggagctgacccgcggcccgtcctaccgcggccgcgacctgccctaccacagcaactcggagaagaagaggaaaaaggagcccgccaagaaaaccaatgactttccaaccaggatgtcccttgtggtctgatgttgtcaacatttctctggataatgagaaatcagacatggactacggggacaagacacaaatctaagaaccagcaggcccaggaccttctctggccatcaccttggaagatttgctgatctctgctttggcaagggatggcaggcagcctttaagggaggctgatttcaaacctctgtgcccatctaactagtttgagaagcttaccaagaaagcaagaatgtgtgagaacattcctacatacagagtttctcaactatagcgtttatcctgcccagcctcctcccttaacagaaccaggactccatttgcaattctgaaagagagttagctctggactgctaaactccagaaattgcctatgcctacaatatgcttttctatacctcctgtgctatacttagagacagaagaatttattactactattagaaggccttcttctgacaagggaagatagcttcaagtcaaaatataccttttatccccatcactttacagtcactagtcaatgactgttgttacactaaaatcaaaaggcctttggtgagctcagtgacagtgacctctgggacaatcacagaaatgacttcact

SEQ ID NO: 2842 - DNA, 4362 bp, Homo sapiens
gtgcgctcttcaggacagcagaggtcggttggaggtctgcattctctgccgacttgggccccaacttccccatcaggtcactgctccctcctctgaggtctggacaaaggacaaggctgtagggacctagactgtcctagacggggaggacatctatcctcagtggtctttccagcagtttgtttggagctgctcatcctgatcttttggctgactctggcagagggaaagtcagatttgaggcctgagctctaacaggcatccagagaggaaggaagggcccaccccgtgacatcagtgaaacggaagcaccctgcaggtgacatcactgttgctcagggcaacgcctccaccctaaggcggacggggaggtgaaaaatcggcctcaagtgtgagacgcatgttgaagggaagggacatagaaggtgtaacgttcacaggaaagctccaaccatggccatggggctcttccgcgtgtgtctggtggtggtgacggccatcatcaaccacccgctgctgttcccgcgggagaacgccacagtccccgagaacgaggaggagatcatccgcaagatgcaggcgcaccaggagaagctgcagctggagcagttgcgcctggaggaggaggtggctcggctggcggccgaaaaggaggcactggagcaggtggcggaggagggcaggcagcagaacgagacacgcgtggcctgggacctctggagcaccctctgcatgatcctcttcctgatgatcgaggtgtggcggcaggaccaccaggaggggccctcacctgagtgcctgggcggtgaggaggatgagctgcctgggctggggggcgcccccttgcagggcctcaccctgcccaacaaggccacgcttggccacttttatgagcgctgcatccggggggccacggccgatgcagcccgtacccgggagttcctggaaggcttcgtggatgacttgctggaagccctgaggagcctctgcaaccgggacaccgacatggaggtggaggacttcattggcgtggacagcatgtacgagaactggcaggtggacaggccactgctgtgccaccttttcgtgcccttcacaccccccgagccctaccgcttccacccagagctctggtgctccggccgctcagtgcccctggatcgccagggctacggccagatcaaggtggtccgcgccgatggggacacattgagctgcatctgcggcaagaccaagctcggggaagacatgctgtgtctcctgcacggcaggaacagcatggcgcctccctgcggcgacatggagaacctgctgtgtgccacagattccctgtacctggacacgatgcaggtcatgaagtggttccagacggccctcaccagagcctggaagggcatcgcccacaagtacgagttcgacctggcctttggccagctggacagcccggggtccctgaagatcaagttccgttcagggaagttcatgcccttcaacctgattcctgtgatccagtgtgatgactcggacctgtactttgtctcccaccttcccagggagccctctgagggcaccccagcctccagcacagactggctcctgtcctttgctgtctatgagcgacacttcctcaggacgacactaaaggcactgcccgagggcgcctgccacctcagctgcctgcagatagcatccttcctgctctccaagcagagccgcctgaccggtcccagcgggctcagcagctaccacctgaagacggccctactgcacctcctactcctccggcaggccgccgactggaaggcggggcagctggacgctcgtctgcacgagttgctgtgcttcctggagaagagcttgctccagaagaagctccaccacttcttcatcggcaaccgcaaggtgcctgaggccatgggactccctgaggccgtgctcagggccgagcccctcaacctcttccggcccttcgtcctgcagcgaagcctttaccgtaagacactggactccttctatgagatgctcaagaatgccccagcgctcattagcgagtattccctacatgtcccctcagaccagcctaccccaaaaagctgacgtcttttacagaatgtgggatcctcgagctaagatgagggcatccctcacgttcacacccctggtggcatctgccagccctgttctggggacaaggcgggctttcgtgggagccgtgctcagcctgccaggaagccaagccctacagtgcagaggaaacagaatttcaacgggaagctggtttgcttcataccattgggatctgctggtaaagctgttatttgggtttagggactgatcccttgcagtttacttctggatcaccatgaatggccaagatggtggcagaacacgctgtggaccctgagttagagacaatgcaaatgttggattgggtgtaattctttttgaatcccagatccagtctgtacttgaatatgagcagaggatctacaagaatgctgacagggaaccgtgttaagacccagcacccctattcccaggagcttctggcctgaccatctgcagccaaagcactaacagggacagatatgggaatgtccacctttgatccgcatcctgcacaatagtggtcccaccatggctgccacttttttatactatttggagaaaagaccttgtataaattcgaggcccaaatgactaacgtctctgtcacacggaaatgggtacttggtggcatagagaaacacaattagccactttttcagctacacttctcactcagctgcaccctacacttctcactcaggtgcacccccttctgctgtcctttccccaacgtactgggtcccgagcgtggtgggtatttgccacactgggtgccagctcagcagccccccacctctctttattctctccaaagctggtctttctgactatcattgtggtagggggaggacagatgctaaaggtggaagctgacctggagaaagagacacacggggtgactgtggcaaaggacagctggaaaagaaactctatcacttcttcattggcaaccacaaggcacctgaggccatggcactcccagaggctgtgcgcagagccaagcctctcaacctcttctggccctgcgtcctgcagcgaagtctctgctgtaagacagtagactccttcgatgaggtgctcaaaaatgctacccggggtggtggtgtctggcttgcagtctggcccagttcagagaaagttgcagagatcaggggccaaggatgtcatagccccaggttgtcctcagggtcccaatcctagggcagggtgtgcatggaagcaagaactatggaaacctagctccagtctgcaggctctgagcccctagttcctcactccagcggggctccctcactgcacagaacccaccccttctgtgtgggcactgctgaccacacagatgacccagacccaaagagcctggcagaagctctgtggttggagctgggctccgtctccaggtctggttcagggggatcaggaaggctcttttccacctgtggcttcactggccctttgagatttcctatctcaccgttacttcagttacccttgcagggggccagggagtcaagaatataccgtgttcctccagggtttaagccggccatgccttcccgagagcataaccaacttgacaggggtgcccagttaccccacaaactgaaggaaggagatccttcccccatccccaggagtgctctcaaccagcctcagaaagcttgagaagatggaccctttgcccaccagggttaattcctggtggggcagctcggctgtgatcagggcaaccaaacctataggaagccttccagtgtgagctggaattagactgaacatgtgcttgggcctgcctctccctagacgcagttgcggggcactccagggaatgaaccagctcaagtgtgtccctaacagcagcctggagctacccccaatccctcacagcctgaccctcctcattccatcagatgcatttgtagaatcggggcaaatttccttatttatttatggcccatgcctttccccctcttcatcctgatcccgttttgctttgaagagaccccagtaaccaaaaaacagcctccagaagccaaaaccatgcctggatctcccatagcttctcctttgcttccaggagaaagttcactgaaaaaaaaatatcttctggcttcttgtgtgtacagagacaacagaactcggtggggaaacgggaatcttttctgcaccaaagctgcttctaaagcagaaagcagtggggctcttggtgtttcatgctgccttatttatattaaaggaagaattaaatcttgc

SEQ ID NO: 2843 - DNA, 4088 bp, Homo sapiens
agcgggggcatcgccgcccgcgcccctctaagtgccgggccgcaagctccaccgcagccgcctgcaagcagcggcgcctcggccctcgacctgcgcgcaaagcctgtgctggagccgtcctcccgcggcggggaccgggaccggggacccaagccaatcgaaagctccaaccatggccatggggctcttccgcgtgtgtctggtggtggtgacggccatcatcaaccacccgctgctgttcccgcgggagaacgccacagtccccgagaacgaggaggagatcatccgcaagatgcaggcgcaccaggagaagctgcagctggagcagttgcgcctggaggaggaggtggctcggctggcggccgaaaaggaggcactggagcaggtggcggaggagggcaggcagcagaacgagacacgcgtggcctgggacctctggagcaccctctgcatgatcctcttcctgatgatcgaggtgtggcggcaggaccaccaggaggggccctcacctgagtgcctgggcggtgaggaggatgagctgcctgggctggggggcgcccccttgcagggcctcaccctgcccaacaaggccacgcttggccacttttatgagcgctgcatccggggggccacggccgatgcagcccgtacccgggagttcctggaaggcttcgtggatgacttgctggaagccctgaggagcctctgcaaccgggacaccgacatggaggtggaggacttcattggcgtggacagcatgtacgagaactggcaggtggacaggccactgctgtgccaccttttcgtgcccttcacaccccccgagccctaccgcttccacccagagctctggtgctccggccgctcagtgcccctggatcgccagggctacggccagatcaaggtggtccgcgccgatggggacacattgagctgcatctgcggcaagaccaagctcggggaagacatgctgtgtctcctgcacggcaggaacagcatggcgcctccctgcggcgacatggagaacctgctgtgtgccacagattccctgtacctggacacgatgcaggtcatgaagtggttccagacggccctcaccagagcctggaagggcatcgcccacaagtacgagttcgacctggcctttggccagctggacagcccggggtccctgaagatcaagttccgttcagggaagttcatgcccttcaacctgattcctgtgatccagtgtgatgactcggacctgtactttgtctcccaccttcccagggagccctctgagggcaccccagcctccagcacagactggctcctgtcctttgctgtctatgagcgacacttcctcaggacgacactaaaggcactgcccgagggcgcctgccacctcagctgcctgcagatagcatccttcctgctctccaagcagagccgcctgaccggtcccagcgggctcagcagctaccacctgaagacggccctactgcacctcctactcctccggcaggccgccgactggaaggcggggcagctggacgctcgtctgcacgagttgctgtgcttcctggagaagagcttgctccagaagaagctccaccacttcttcatcggcaaccgcaaggtgcctgaggccatgggactccctgaggccgtgctcagggccgagcccctcaacctcttccggcccttcgtcctgcagcgaagcctttaccgtaagacactggactccttctatgagatgctcaagaatgccccagcgctcattagcgagtattccctacatgtcccctcagaccagcctaccccaaaaagctgacgtcttttacagaatgtgggatcctcgagctaagatgagggcatccctcacgttcacacccctggtggcatctgccagccctgttctggggacaaggcgggctttcgtgggagccgtgctcagcctgccaggaagccaagccctacagtgcagaggaaacagaatttcaacgggaagctggtttgcttcataccattgggatctgctggtaaagctgttatttgggtttagggactgatcccttgcagtttacttctggatcaccatgaatggccaagatggtggcagaacacgctgtggaccctgagttagagacaatgcaaatgttggattgggtgtaattctttttgaatcccagatccagtctgtacttgaatatgagcagaggatctacaagaatgctgacagggaaccgtgttaagacccagcacccctattcccaggagcttctggcctgaccatctgcagccaaagcactaacagggacagatatgggaatgtccacctttgatccgcatcctgcacaatagtggtcccaccatggctgccacttttttatactatttggagaaaagaccttgtataaattcgaggcccaaatgactaacgtctctgtcacacggaaatgggtacttggtggcatagagaaacacaattagccactttttcagctacacttctcactcagctgcaccctacacttctcactcaggtgcacccccttctgctgtcctttccccaacgtactgggtcccgagcgtggtgggtatttgccacactgggtgccagctcagcagccccccacctctctttattctctccaaagctggtctttctgactatcattgtggtagggggaggacagatgctaaaggtggaagctgacctggagaaagagacacacggggtgactgtggcaaaggacagctggaaaagaaactctatcacttcttcattggcaaccacaaggcacctgaggccatggcactcccagaggctgtgcgcagagccaagcctctcaacctcttctggccctgcgtcctgcagcgaagtctctgctgtaagacagtagactccttcgatgaggtgctcaaaaatgctacccggggtggtggtgtctggcttgcagtctggcccagttcagagaaagttgcagagatcaggggccaaggatgtcatagccccaggttgtcctcagggtcccaatcctagggcagggtgtgcatggaagcaagaactatggaaacctagctccagtctgcaggctctgagcccctagttcctcactccagcggggctccctcactgcacagaacccaccccttctgtgtgggcactgctgaccacacagatgacccagacccaaagagcctggcagaagctctgtggttggagctgggctccgtctccaggtctggttcagggggatcaggaaggctcttttccacctgtggcttcactggccctttgagatttcctatctcaccgttacttcagttacccttgcagggggccagggagtcaagaatataccgtgttcctccagggtttaagccggccatgccttcccgagagcataaccaacttgacaggggtgcccagttaccccacaaactgaaggaaggagatccttcccccatccccaggagtgctctcaaccagcctcagaaagcttgagaagatggaccctttgcccaccagggttaattcctggtggggcagctcggctgtgatcagggcaaccaaacctataggaagccttccagtgtgagctggaattagactgaacatgtgcttgggcctgcctctccctagacgcagttgcggggcactccagggaatgaaccagctcaagtgtgtccctaacagcagcctggagctacccccaatccctcacagcctgaccctcctcattccatcagatgcatttgtagaatcggggcaaatttccttatttatttatggcccatgcctttccccctcttcatcctgatcccgttttgctttgaagagaccccagtaaccaaaaaacagcctccagaagccaaaaccatgcctggatctcccatagcttctcctttgcttccaggagaaagttcactgaaaaaaaaatatcttctggcttcttgtgtgtacagagacaacagaactcggtggggaaacgggaatcttttctgcaccaaagctgcttctaaagcagaaagcagtggggctcttggtgtttcatgctgccttatttatattaaaggaagaattaaatcttgcaaggagt

SEQ ID NO: 2844 - DNA, 3981 bp, Homo sapiens
gaacagtctgggatttctttcactgtgtggggcctagaatctcaggaagccaggacgtgggaaagctccaaccatggccatggggctcttccgcgtgtgtctggtggtggtgacggccatcatcaaccacccgctgctgttcccgcgggagaacgccacagtccccgagaacgaggaggagatcatccgcaagatgcaggcgcaccaggagaagctgcagctggagcagttgcgcctggaggaggaggtggctcggctggcggccgaaaaggaggcactggagcaggtggcggaggagggcaggcagcagaacgagacacgcgtggcctgggacctctggagcaccctctgcatgatcctcttcctgatgatcgaggtgtggcggcaggaccaccaggaggggccctcacctgagtgcctgggcggtgaggaggatgagctgcctgggctggggggcgcccccttgcagggcctcaccctgcccaacaaggccacgcttggccacttttatgagcgctgcatccggggggccacggccgatgcagcccgtacccgggagttcctggaaggcttcgtggatgacttgctggaagccctgaggagcctctgcaaccgggacaccgacatggaggtggaggacttcattggcgtggacagcatgtacgagaactggcaggtggacaggccactgctgtgccaccttttcgtgcccttcacaccccccgagccctaccgcttccacccagagctctggtgctccggccgctcagtgcccctggatcgccagggctacggccagatcaaggtggtccgcgccgatggggacacattgagctgcatctgcggcaagaccaagctcggggaagacatgctgtgtctcctgcacggcaggaacagcatggcgcctccctgcggcgacatggagaacctgctgtgtgccacagattccctgtacctggacacgatgcaggtcatgaagtggttccagacggccctcaccagagcctggaagggcatcgcccacaagtacgagttcgacctggcctttggccagctggacagcccggggtccctgaagatcaagttccgttcagggaagttcatgcccttcaacctgattcctgtgatccagtgtgatgactcggacctgtactttgtctcccaccttcccagggagccctctgagggcaccccagcctccagcacagactggctcctgtcctttgctgtctatgagcgacacttcctcaggacgacactaaaggcactgcccgagggcgcctgccacctcagctgcctgcagatagcatccttcctgctctccaagcagagccgcctgaccggtcccagcgggctcagcagctaccacctgaagacggccctactgcacctcctactcctccggcaggccgccgactggaaggcggggcagctggacgctcgtctgcacgagttgctgtgcttcctggagaagagcttgctccagaagaagctccaccacttcttcatcggcaaccgcaaggtgcctgaggccatgggactccctgaggccgtgctcagggccgagcccctcaacctcttccggcccttcgtcctgcagcgaagcctttaccgtaagacactggactccttctatgagatgctcaagaatgccccagcgctcattagcgagtattccctacatgtcccctcagaccagcctaccccaaaaagctgacgtcttttacagaatgtgggatcctcgagctaagatgagggcatccctcacgttcacacccctggtggcatctgccagccctgttctggggacaaggcgggctttcgtgggagccgtgctcagcctgccaggaagccaagccctacagtgcagaggaaacagaatttcaacgggaagctggtttgcttcataccattgggatctgctggtaaagctgttatttgggtttagggactgatcccttgcagtttacttctggatcaccatgaatggccaagatggtggcagaacacgctgtggaccctgagttagagacaatgcaaatgttggattgggtgtaattctttttgaatcccagatccagtctgtacttgaatatgagcagaggatctacaagaatgctgacagggaaccgtgttaagacccagcacccctattcccaggagcttctggcctgaccatctgcagccaaagcactaacagggacagatatgggaatgtccacctttgatccgcatcctgcacaatagtggtcccaccatggctgccacttttttatactatttggagaaaagaccttgtataaattcgaggcccaaatgactaacgtctctgtcacacggaaatgggtacttggtggcatagagaaacacaattagccactttttcagctacacttctcactcagctgcaccctacacttctcactcaggtgcacccccttctgctgtcctttccccaacgtactgggtcccgagcgtggtgggtatttgccacactgggtgccagctcagcagccccccacctctctttattctctccaaagctggtctttctgactatcattgtggtagggggaggacagatgctaaaggtggaagctgacctggagaaagagacacacggggtgactgtggcaaaggacagctggaaaagaaactctatcacttcttcattggcaaccacaaggcacctgaggccatggcactcccagaggctgtgcgcagagccaagcctctcaacctcttctggccctgcgtcctgcagcgaagtctctgctgtaagacagtagactccttcgatgaggtgctcaaaaatgctacccggggtggtggtgtctggcttgcagtctggcccagttcagagaaagttgcagagatcaggggccaaggatgtcatagccccaggttgtcctcagggtcccaatcctagggcagggtgtgcatggaagcaagaactatggaaacctagctccagtctgcaggctctgagcccctagttcctcactccagcggggctccctcactgcacagaacccaccccttctgtgtgggcactgctgaccacacagatgacccagacccaaagagcctggcagaagctctgtggttggagctgggctccgtctccaggtctggttcagggggatcaggaaggctcttttccacctgtggcttcactggccctttgagatttcctatctcaccgttacttcagttacccttgcagggggccagggagtcaagaatataccgtgttcctccagggtttaagccggccatgccttcccgagagcataaccaacttgacaggggtgcccagttaccccacaaactgaaggaaggagatccttcccccatccccaggagtgctctcaaccagcctcagaaagcttgagaagatggaccctttgcccaccagggttaattcctggtggggcagctcggctgtgatcagggcaaccaaacctataggaagccttccagtgtgagctggaattagactgaacatgtgcttgggcctgcctctccctagacgcagttgcggggcactccagggaatgaaccagctcaagtgtgtccctaacagcagcctggagctacccccaatccctcacagcctgaccctcctcattccatcagatgcatttgtagaatcggggcaaatttccttatttatttatggcccatgcctttccccctcttcatcctgatcccgttttgctttgaagagaccccagtaaccaaaaaacagcctccagaagccaaaaccatgcctggatctcccatagcttctcctttgcttccaggagaaagttcactgaaaaaaaaatatcttctggcttcttgtgtgtacagagacaacagaactcggtggggaaacgggaatcttttctgcaccaaagctgcttctaaagcagaaagcagtggggctcttggtgtttcatgctgccttatttatattaaaggaagaattaaatcttg

SEQ ID NO: 2845 - DNA, 796 bp, Homo sapiens
gtgcgctcttcaggacagcagaggtcggttggaggtctgcattctctgccgacttgggccccaacttccccatcaggtcactgctccctcctctgaggtctggacaaaggacaaggctgtagggacctagactgtcctagacggggaggacatctatcctcagtggtctttccagcagtttgtttggagctgctcatcctgatcttttggctgactctggcagagggaaagtcagatttgaggcctgagctctaacaggcatccagagaggaaggaagggcccaccccgtgacatcagtgaaacggaagcaccctgcaggtgacatcactgttgctcagggcaacgcctccaccctaaggcggacggggaggtgaaaaatcggcctcaagtgtgagacgcatgttgaagggaagggacatagaaggtgtaacgttcacaggaaagctccaaccatggccatggggctcttccgcgtgtgtctggtggtggtgacggccatcatcaaccacccgctgctgttcccgcgggagaacgccacagtccccgagaacgaggaggagatcatccgcaagatgcaggcgcaccaggagaagctgcagctggagcagttgcgcctggaggaggaggtggctcggctggcggccgaaaaggaggcactggagcaggtggcggaggagggcaggcagcagaacgagacacgcgtggcctgggacctctggagcaccctctgcatgatcctcttcctgatgatcgaggtgtggcggcaggaccaccaggaggggccctcacctgagt

SEQ ID NO: 2846 - DNA, 2156 bp, Homo sapiens
ccggggcagaggaaaggtgtcacccaggcaggttcagggctttctggctataaaagggagcctctgggatcagcaggtcatatctggtgcccatggttgactgaggagtcgggtgaggccaccctaccacaagggtccccctccccatcctacacaggaatgaaaacagtcccatgtacactttctggaagcctaaataccacccacaccatgtggaaggaaagcaggagagagactgagtggcacatcctttcgccctcttttctctcgaacctcctcccaggccgaccacccttgctgtgtccaagccaagctctgtgggctttctgttcctcctgagtagctgattttcagaatttggggtaccagggctctggggaatgtgagctagagagcagataagtctggaagatgaccactgactcctactctcctacttctccagatgcagaggcctccatggctgtgataagcctgctgttcttggcagtgatgtatgttgttcaccaccctctgatggtcagtgatcggatggacctggacacattagccaggagtcggcagctggagaagcgaatgagtgaggagatgcgcctgctagagatggagtttgaagagagaaagcgagccgctgagcagaggcagaaggcagagaacttctggacaggagacacatccagtgaccagttagtgctggggaagaaagacatggggtggccgttccaggccgatggccaggaagggcctctgggctggatgctgggaaacctgtggaacactggcctcttttgcctttttctcgtctttgagctcctgcgacagaacatgcagcatgaaccggcctttgattccagcagtgaggaggaggaggaggaagtccgtgttgtccctgtcacctcttacaactggcttactgacttcccctcccaggaggccctggactccttttacaaacactatgtccaaaatgccatccgtgacctgccctgcacctgtgagtttgtggagagttttgtggatgatctcattgaggcctgtcgggtgctcagccgccaagaggctcacccacaattggaagactgcctgggcatcggggctgcctttgagaaatggggaaccctccatgagacccagaaatttgatatcctggtgcccattgtccccccacagggcaccatgtttgtcctggagatgagggacccagccctgggccgccgctgtggctgtgtgctggtggagtcagaatgtgtgtgcaagcgtgagaaactcctaggggacgtgctgtgcctggtgcaccaccacagggacccctcggcagtcttggggaagtgtagtagctccatcaaggcagctctctgcaccggcttccacctagacgtgtgcaagactgtgcagtggttccggaacatgatgggcaatgcctgggcccttgtggcccacaagtatgactttaaactcagtctcccaccgtctaccacctcctgcaagctccggctggactatcgctcaggccgctttctctcaatccacttggtcctgggggtgcaacgagaagacaccttggtctacctggtgagtcaggctcctgaccaggagcagctcaccagtgtggactggcctgagtcctttgtggcctgtgagcacctgttcctgaagctggtggggcgctttgcccccgagaacacctgtcacctcaagtgcctccagatcattttaagtctccggcagcatcagagcttaccccatggagcatcccgccccatcctcacttcttaccattttaaaacagctctcatgcacctcttgctacggctgcccctcacggactgggcccacaacatgctctctcagcggctccaggacattctctggttcttgggccgtggcctccagcaaaggtccctccatcatttcctcattggtaacaattttctgcccctgaccatcccaatccctaagacatttaggaatgctgagccggtcaatctcttccaacacctggtgctcaaccccaaggcacattcacaggcagtggaagagttccaaaaccttctgacccaggtgaaaactctgcctcatgccccactggctgcagcaccttgatgtaaagaccattaaaaaaaaaacagaggaaggtatttctaattccttgggct

SEQ ID NO: 2847 - DNA, 1946 bp, Homo sapiens
gctcggacaagcatggtctataacccaggaaaggggagcagggccactcccgcgggcggccccagcgatgaaccggacgcccccaccctgccgggaaaaaagcagtggcggtcaggccgcgctgtctctttaagatcgtgttcctactaacactgacgggctcctagagagggcggggagacgaagcaaggccaagttccaaagggaggataggcccagctggcttcagcgtccacacggcatagtccttcatgaatgttgatgcagaggcctccatggctgtgataagcctgctgttcttggcagtgatgtatgttgttcaccaccctctgatggtcagtgatcggatggacctggacacattagccaggagtcggcagctggagaagcgaatgagtgaggagatgcgcctgctagagatggagtttgaagagagaaagcgagccgctgagcagaggcagaaggcagagaacttctggacaggagacacatccagtgaccagttagtgctggggaagaaagacatggggtggccgttccaggccgatggccaggaagggcctctgggctggatgctgggaaacctgtggaacactggcctcttttgcctttttctcgtctttgagctcctgcgacagaacatgcagcatgaaccggcctttgattccagcagtgaggaggaggaggaggaagtccgtgttgtccctgtcacctcttacaactggcttactgacttcccctcccaggaggccctggactccttttacaaacactatgtccaaaatgccatccgtgacctgccctgcacctgtgagtttgtggagagttttgtggatgatctcattgaggcctgtcgggtgctcagccgccaagaggctcacccacaattggaagactgcctgggcatcggggctgcctttgagaaatggggaaccctccatgagacccagaaatttgatatcctggtgcccattgtccccccacagggcaccatgtttgtcctggagatgagggacccagccctgggccgccgctgtggctgtgtgctggtggagtcagaatgtgtgtgcaagcgtgagaaactcctaggggacgtgctgtgcctggtgcaccaccacagggacccctcggcagtcttggggaagtgtagtagctccatcaaggcagctctctgcaccggcttccacctagacgtgtgcaagactgtgcagtggttccggaacatgatgggcaatgcctgggcccttgtggcccacaagtatgactttaaactcagtctcccaccgtctaccacctcctgcaagctccggctggactatcgctcaggccgctttctctcaatccacttggtcctgggggtgcaacgagaagacaccttggtctacctggtgagtcaggctcctgaccaggagcagctcaccagtgtggactggcctgagtcctttgtggcctgtgagcacctgttcctgaagctggtggggcgctttgcccccgagaacacctgtcacctcaagtgcctccagatcattttaagtctccggcagcatcagagcttaccccatggagcatcccgccccatcctcacttcttaccattttaaaacagctctcatgcacctcttgctacggctgcccctcacggactgggcccacaacatgctctctcagcggctccaggacattctctggttcttgggccgtggcctccagcaaaggtccctccatcatttcctcattggtaacaattttctgcccctgaccatcccaatccctaagacatttaggaatgctgagccggtcaatctcttccaacacctggtgctcaaccccaaggcacattcacaggcagtggaagagttccaaaaccttctgacccaggtgaaaactctgcctcatgccccactggctgcagcaccttgatgtaaagaccattaaaaaaaaaacaga

SEQ ID NO: 2848 - DNA, 1947 bp, Homo sapiens
gctgcggcgcgcgggcgccctcggagccgcgtgctgggggtcgtaggggcccaccgcgctcagccagacgttcagacgctcggacaagcatggtctataacccaggaaaggggagcagggccactcccgcgggcggccccagcgatgaaccggacgcccccaccctgccgggaaaaaagcagtggcggtcaggccgcgctgtctctttaagatcgtgttcctactaacactgacgatgcagaggcctccatggctgtgataagcctgctgttcttggcagtgatgtatgttgttcaccaccctctgatggtcagtgatcggatggacctggacacattagccaggagtcggcagctggagaagcgaatgagtgaggagatgcgcctgctagagatggagtttgaagagagaaagcgagccgctgagcagaggcagaaggcagagaacttctggacaggagacacatccagtgaccagttagtgctggggaagaaagacatggggtggccgttccaggccgatggccaggaagggcctctgggctggatgctgggaaacctgtggaacactggcctcttttgcctttttctcgtctttgagctcctgcgacagaacatgcagcatgaaccggcctttgattccagcagtgaggaggaggaggaggaagtccgtgttgtccctgtcacctcttacaactggcttactgacttcccctcccaggaggccctggactccttttacaaacactatgtccaaaatgccatccgtgacctgccctgcacctgtgagtttgtggagagttttgtggatgatctcattgaggcctgtcgggtgctcagccgccaagaggctcacccacaattggaagactgcctgggcatcggggctgcctttgagaaatggggaaccctccatgagacccagaaatttgatatcctggtgcccattgtccccccacagggcaccatgtttgtcctggagatgagggacccagccctgggccgccgctgtggctgtgtgctggtggagtcagaatgtgtgtgcaagcgtgagaaactcctaggggacgtgctgtgcctggtgcaccaccacagggacccctcggcagtcttggggaagtgtagtagctccatcaaggcagctctctgcaccggcttccacctagacgtgtgcaagactgtgcagtggttccggaacatgatgggcaatgcctgggcccttgtggcccacaagtatgactttaaactcagtctcccaccgtctaccacctcctgcaagctccggctggactatcgctcaggccgctttctctcaatccacttggtcctgggggtgcaacgagaagacaccttggtctacctggtgagtcaggctcctgaccaggagcagctcaccagtgtggactggcctgagtcctttgtggcctgtgagcacctgttcctgaagctggtggggcgctttgcccccgagaacacctgtcacctcaagtgcctccagatcattttaagtctccggcagcatcagagcttaccccatggagcatcccgccccatcctcacttcttaccattttaaaacagctctcatgcacctcttgctacggctgcccctcacggactgggcccacaacatgctctctcagcggctccaggacattctctggttcttgggccgtggcctccagcaaaggtccctccatcatttcctcattggtaacaattttctgcccctgaccatcccaatccctaagacatttaggaatgctgagccggtcaatctcttccaacacctggtgctcaaccccaaggcacattcacaggcagtggaagagttccaaaaccttctgacccaggtgaaaactctgcctcatgccccactggctgcagcaccttgatgtaaagaccattaaaaaaaaaacagaggaaggtatttctaattccttgggcta

SEQ ID NO: 2849 - DNA, 1814 bp, Homo sapiens
ggaaaggtgtcacccaggcaggttcagggctttctggctataaaagggagcctctgggatcagcaggtcatatctggtgcccatggttgactgaggagtcggatgcagaggcctccatggctgtgataagcctgctgttcttggcagtgatgtatgttgttcaccaccctctgatggtcagtgatcggatggacctggacacattagccaggagtcggcagctggagaagcgaatgagtgaggagatgcgcctgctagagatggagtttgaagagagaaagcgagccgctgagcagaggcagaaggcagagaacttctggacaggagacacatccagtgaccagttagtgctggggaagaaagacatggggtggccgttccaggccgatggccaggaagggcctctgggctggatgctgggaaacctgtggaacactggcctcttttgcctttttctcgtctttgagctcctgcgacagaacatgcagcatgaaccggcctttgattccagcagtgaggaggaggaggaggaagtccgtgttgtccctgtcacctcttacaactggcttactgacttcccctcccaggaggccctggactccttttacaaacactatgtccaaaatgccatccgtgacctgccctgcacctgtgagtttgtggagagttttgtggatgatctcattgaggcctgtcgggtgctcagccgccaagaggctcacccacaattggaagactgcctgggcatcggggctgcctttgagaaatggggaaccctccatgagacccagaaatttgatatcctggtgcccattgtccccccacagggcaccatgtttgtcctggagatgagggacccagccctgggccgccgctgtggctgtgtgctggtggagtcagaatgtgtgtgcaagcgtgagaaactcctaggggacgtgctgtgcctggtgcaccaccacagggacccctcggcagtcttggggaagtgtagtagctccatcaaggcagctctctgcaccggcttccacctagacgtgtgcaagactgtgcagtggttccggaacatgatgggcaatgcctgggcccttgtggcccacaagtatgactttaaactcagtctcccaccgtctaccacctcctgcaagctccggctggactatcgctcaggccgctttctctcaatccacttggtcctgggggtgcaacgagaagacaccttggtctacctggtgagtcaggctcctgaccaggagcagctcaccagtgtggactggcctgagtcctttgtggcctgtgagcacctgttcctgaagctggtggggcgctttgcccccgagaacacctgtcacctcaagtgcctccagatcattttaagtctccggcagcatcagagcttaccccatggagcatcccgccccatcctcacttcttaccattttaaaacagctctcatgcacctcttgctacggctgcccctcacggactgggcccacaacatgctctctcagcggctccaggacattctctggttcttgggccgtggcctccagcaaaggtccctccatcatttcctcattggtaacaattttctgcccctgaccatcccaatccctaagacatttaggaatgctgagccggtcaatctcttccaacacctggtgctcaaccccaaggcacattcacaggcagtggaagagttccaaaaccttctgacccaggtgaaaactctgcctcatgccccactggctgcagcaccttgatgtaaagaccattaaaaaaaaaacagaggaaggtatttctaattccttgggcta

SEQ ID NO: 2850 - DNA, 7693 bp, Homo sapiens
gtcgctttaaggcggaggcccgggagggggccgacccggctcgccagctccacgctcggctccagactccggcatttcctccccgctagctggcgcggcctcgcctccccctcggaagaggaaactcccggggtccgagtaacagggtcaggcgcggagaggagcggcgggagagccaggagggccgcccagggtaggaggcgagccaggccgggccagaagctggccgacggcggcgcgcgggggcgccgggcggggagggccgctgggccggactcagcgcgcagccggggcagggcgcggcccggggcccgagagcgcagggcgggccgcagctggaaggaacacttgagctgggagaggaggccgagctggagggcggcctccctcgggcctgcgttcgggaagccgccgcggaggaggagacggggacagcggggctgcccgggcgctgtgcgcatgctgggcttgggtcgccgccggggcttgccccctgggctgctcggccaccgccgccccgggcgcccggcatgtcggtgcactacaccctcaatctacgcgtcttctggcccctggtgaccggcctgtgcaccgccctggtgtgcctctaccatgtcctgcggggaagcgggggcgcccgggccgagcccgccgacggcgtggatggcggcttcccgttgcttaaggtggccgtcctgctcctcctcagctatgtcctcctgcgctgtcgccacgctgtccggcagcgcttcctgcccgggtctccccgtctggagggtcacgccgccttctcctcgagacacttccgagagccgggcctcagcatcctgctggagagttactacgagcatgaggtgcgcctgtctccgcacgtgttgggccacagcaaggcgcacgtgagccggatcgtgggcgagctggtgcgggctggccgcgcccgggggtcccccggtctcattcctgggggagcgctggccttggccttccgcggagacttcatccaggtgggcagcgcctacgagcaacataaaatccgccggcccgacagcttcgacgtgctggtgccactgcgcctcccgccgcttgtggcgctggagccacggagcctgggcgaggagccagcgctggccccggccttccgcggctgcttcttgtgcgccctcaaggcaccaccctcaccatcgggggcctcggggggccactggcttcgggactgcaaaccctttgctgatgccttctgcgtggatgtgcgcgggcggcgtcacctctctgctactctggtgctgcgctggttccagtcgcatctgcagcgctccttggccactgtgcgttacagcctggaggggcgctgtcgggtcaccttgaccccaggtggcctggaacagccccccaccttacacatcttgccctgccgcactgactacggctgctgccgcctttctatggctgtgcgtctcatccccgctgtccatctgggagatggggtcttccttgtggcgccaccaccgccacccttgcccagcgcgcccctgttggagctccctgagggcctgcgtgcggaggcactgtggggtgtgaacacagcacgccaggagcagaagctgctgagttggctgcaggaacgggcagctccaggtgcctgctacctcaagtgcctgcagttgcttaaggctctgcgcgatctgggggcccgtgggctggactcagcggccgccacccagtggggacgcatcctatcctcatatgtgctcaagacagtgctgctggcagtgctgctgcgcaagggggcccctgggcaaggctgggacgaggagcacctgggaaggtgtttggaggagttggtgcagttccttagggactgcctgctgcgacgccatacgctcttccactgcgtcctgggccctggtggggcggctgccgaggtgggtcccctgcccaaggcactgagggaagccgccccagttgacctcctggccgctttcgacgggcacgcccgggaacttgcagcagcgcggttgctgtccacgtggcaaaggctgccccagcttctccgggcctacgggggtccccgctaccttgccaggtgccccccaccccggagtcagcgcacccagggcttccttgaaggtgaaccgtaaaccctgacagcacccccacctgaccaaatgctcctaaagcctttcccactgggtgggggtgggaatggcggtgaagccagttaaatgcaagattgcagaaggcattggaaaatttggtggctgccacaagctttagtggcttaaatatcaccttctcgcttcacagtccagtataatatgacatcttcacacccactagagtgtcctgggcaaaccatgggaagacatccaacaggagacccaagaattggttcaaatattgttctgtgtagacggattctgtagaaggatgtggcttttagagaagtccagtagaagaagcaagaactagctgcagggaaagttccttctgtcggtttttagacacagatctctctgcccaaattaaaaaaaaacaaaacaaaacactaaagtttttgacacaattacttgctaggtactgggttcctgattgtctttaaaaagaaaaatctgaatctttatttgcaactggaattgaagttctattttaggggctaatgtttagaggaacataatttccactgttcaaattaatattaatgtatttttaaaatggtgcaatcacaggtgtttgacaagattgtcaacaagttaagtcacatagatggaaaggcaatcgagagttggttagagaagcttccagagaaaatagcactttatattgatcaattcactcattttgtggtaattgctagcaccaagcattgcatctgaaagggaagccagttatatttattattaaatgtacaaccttgaaaagcagccagcatgcttgcctaactaacatcgccgcaggccacaagctgggatatgtacctgtccgtcaacatccattcattaaactacctactaccagccagagatgtctggaaccaaagtagcaaccaaatacatattcaagacaacactggtgaaggcataaaacatgttggctttggagaaagatgtgttttaggctttgcctgtaaaggtgtttctccaaggctggctgctggctggagacagaaaacttttttgttttaaggtttttagcaaactccttcacaaagagatttctttctgagcttaatgagctaatgaagaggaaatgcctgctgcttagcatgtggtttgtgctgggtctctaaccattgatggttcttccttgtccaggcagtcttacgtggtccaagagacctgttgattcagcacaggtcttgcaaaacatttcacttatagttcagtatcttgggctctgtgcttgaagatcagttactccctggtcgtgggcagaggagacaaattaggaaaagagcaagggagacagcccttgacggcagtctgtctcttttctctttaggtgtcagtatcaccaggttgggtgtattttgcagctgggaggagccggtcctggaattcttccttgttctcccaaatttataacagtcctcaattgcagtttaagttcagcatggcccctcatctgcttgcctgattggaaatgcagccagtccaagtgttacaaattgggatttttttgttttctaaataaaaacatgtacttcctcagactcttaaagctaaaatttggaagacagaaatgcctatgtgaatagaatcattgttgaagttctgagctcttttgagggaactctataagccttctttctttaggggatccacttgcctgctgtgggaaatcatagtgagtgatttacaggaatccttctcctccaagctgcattggcttcttatatcctttgcgaccttgggctgaaagagaaacagctgcaaatgttgtgctgtctctttgaggttgtcttggggacagttccccgcaaaggtcattcctagcttttgaggtcaatgttgggtcataaggtactgcattgtgcaaagaagtcagtctgctaactttatgcaaagatagaaactgcacggtattttttaaaattagtttttaaaataaatgccaagagtagatcttatatatatatatatgtatacatattttatatatatatatatttccatactcaaccacaacttcctctgtactcattgtttactacagtgggggacatcaagggttggaaggattataaagctttaaggctgggcgtggtggctcacgcctgtaatcccagcactttgggaggcgaggtgggcggatcacctgaggtcaggagttcaagaccagcctagccaacatagtgaaactctgtctctactaaaaaatacaaaaattagctgggcgtggtggcgggcgcctgtaatcccagatactcgggaggctaaggcaggagaatcacttgaacccgggaggtgaaggttgcagagagccaagatcacaccactgcactccagcctgggtgaccgagcgagactccgtctcaaaaaaaaaaaaaaaaagctttaaaaagctgaattttagaaatatttctagcagtgtcagtgagttcctcttttaatagtgttttaaagtataaatctggtaacatactgttcttgtagttttttgttagttttgtttttcaggttaattacccaaagcctcatccatcctcaaggtttttaaattttatttttttaaaataaattgtgcattgtatttgtgaatttttaaaatattactgttttatttaaatgccatgctgagcaattgttctctgtacatggtaaccaaaacttagagatttcgatcaattttgatcaatgtttagtaaaccaaaacatgtactgtgtacaacggaaataatatggcatattagccaggcatgatggttgcccaagacagttaaattaagctcaattctgtattttattagggctctgttatgtccttcatctgaaatgtacacatttttggtgtatgcttggtactggagattcatatatgcaaatattctcatgcaagaagttccacagtaacaacagcaaaaagaaaaaattagttgtccagccagtgctggaggaaaatgtttctggggaagatgactcagtcattttgtggcgagacaccctttggtaactcccactgaccagtcttgggagccttcctggaatgatcgtgggctgagcggagatgttttttgcaaaatgaaactgaagctgaaagaaaggagaattcgagtgaaccaagagaaatccaaagacctggggaaggaggacttaagatgaaagtgaagcaagagagggaaggggaaatgaagtgaaaatggcgtgagggtgtgagagaggtttgggttaggaaacatgtttttagtgctatttccaaccaggggtcgcaaactcagcagcctgtagaaacaggggtgggaggtgggggggaagctgtgcccacctttaaagagggggccattgctcagccatgcagaaaaaaatggggcaacaagctggaaatcaggttttttttttttaaagtgaaacttgatgatttttaaacaagtaattaaaaaaatgtccaaaacaccatgtgggccaaacatttgtttgagcctgggggccaccagtttgcgaccactgccttacgtagttaacaccctgagtatgtatacagtcatattttttgttttggatatggtagtgttatatatacttgggggcgtgatatttgaagtcatctttatctctcagagttaagctttattgtagaagaaaaaaaaaaaagttaacacagccatagataacacttaactcacagttcccaggaggacacttgatctcgaagctgctctttttgagtcagatcctacatcaaaccacttagggccagtttttggcatttccttcctggtgatttggggtaaacttctttgctctgtcggagtttgcagatgagtaatcagaaggattgcagaataacttgtttctttgtattttattcttacatttaaattaattttggggggttagtggtatcctagctcgtgcctttacagggatgattggtggctagatttggggtgcaagcttcttaggctcataccatttcaactaccaagaacacaggtttttgtttttgttttttgagacagggtctcagtctgttgcccaggctggagtgcagtggcaagattgcagctcattgcagccttgacctcctgggctcaagcgatcctcctgcctcggcctcccaactagctgggaccacaggtatgtgccactacacccagcgaatttttaaattatttgtagagtcagggtctccctatgttgcccaggctggtcttgaactactggactcaagccatcctcccacctcggcctcccaaagtgttgggattataggcgcgagccaccacacctggcctaaaagcgtcgttctgatcagacttcacccctgaatgtttctatcattttcttttctttttttttttttttcgagacagagttttgctcttgttttacaggctggggtgcggtgggatgatcttggctcactgcaatctcctcctcccaggttcaagtgattcttgggccttagcctcccgagtagctgggattacaggcacctgccaccacgcctggctaatatatatatatatatatatatattttttttttttttttttagtagagatggggtttcatcatgttggccaggctggtctcgaactcctgacctcaggtgatctacctgcctcggcctcccaaagtgcagggattacaggtgtgagtgagccaccgcggccggcctctatcattttctgactcagcagctccaccaaaattgacatcctagcaaacactgtgaaggaattaacctaagtgcttccagagcatctcatgtaacctctatggagtaagtcactttttctgtaacatgtggcttttgaccttgatgaagactttgacttctcatccctgtctacatggaggaagatgattcagtggtggggaaaatgaacctcggtaacatttccaatgtccttcaagagggaaacaagttcagtgttatcatcgtggcattcgttagtttttttttttttaaatcacttgtttagatacaactttatttttttatacctacatagcacatgactggggggataaagcatgtataagttgggagagggtaaagaatgtgtgactatgtatacagaaaatagactaaaatgtgcagcaaaatgatatatactgtaatctggtttttgaagtatctactattctggaatattgttaaacaactttttgcttttgaaaaaaaaaggtgccttgattcagttgcgtgacttagaacattcatcctattttattgtgatttttaatgtcttctgaccccaaactgtgtttttggttgcagtctggcggctgcaggcatagcgtcggttttgttccaataacagagaccaaagagttaatcagatatggttcagctgctacaattgtatgattcaaaggcaatttaatcaccccaaatttccatggcccccacagtcaagacctgccattcgttttctcttgcaggttggagtaaatttgcactttgaatcatgtgggtcatttggggaccttgttcttttctattttgctttattaataaaggaacttgt

SEQ ID NO: 2851 - DNA, 3940 bp, Homo sapiens
gacagcctcttcccccaaccctccctttcctgaattccccctcctcctcgctcaccttaaaaccatcgtgcatcaccatggcgagttgctccttcactcgcgaccaagcgacaagaagactaagaggtgcagcagcggcggcagcggcagctctagcagcagtggtgaccaccccgcttctttcctcgggaaccccgaccgcactcattgggaccgggtcgtcttgtccgggagccatgtggctctccacggccactggctcccggtcagactccgagtccgaagaggaggacctgcccgtcggggaggaagtctgcaaacgcggctacctgcggaaacagaagcatgggcacaggcgctacttcgtgctcaaactcgagactgctgacgccccagctcggctggaatactacgaaaatgccaggaagttccggcacagtgtccgcgccgcggcggctgcagcagcggcggccgcctctggcgccgcgatccccccgctcattccaccgcggcgcgtgatcaccctataccagtgcttttccgtgagccagcgagcagatgcaaggtaccgacacctcattgctcttttcacccaagacgaatacttcgcgatggtggccgagaacgagtcggagcaggaaagctggtacttgctgctcagccgcctcatcctcgagagcaagcgccgccgctgcggcacgctcggcgcgcagccggacggagagccggccgcgctggcggcggcagcggcggcggagccacccttctataaagatgtgtggcaggtaatagtcaaacccagggggctggggcacagaaaagagctgagcggcgtgttccggctgtgtctaaccgacgaggaggtcgtgtttgtgaggctgaacaccgaagtggccagcgtggtcgtccagctcctgagcatccgtcgctgtggacactcggagcagtatttcttcttggaagtaggcaggtccactgtcatcggtccgggagagctctggatgcaggtcgatgactgtgtggttgcccaaaacatgcatgagctgtttttggagaagatgagagccttgtgtgcagacgaatacagagcccgctgccgcagctacagcatcagcatcggcgcccacctgttaaccctgctgtccgctaggaggcacctgggcttggtgccgctcgagccgggaggctggctcagaaggtcccgctttgagcagttttgccacctcagggccatcggcgacggggaagacgagatgcttttcaccaggcgcttcgtaacacccagcgagcctgtggcccactccaggcgaggaagactgcacctgcccagagggcgcaggtcaaggagagcggtttcagtgccggccagcttttttcgccgcttagcacccagcccagcacgtccccggcaccctgcagaagccccgaacaatggagctcgcctgtcttctgaagtgtctggttctggctctggcaactttggggaggaaggcaatccccagggcaaagaagatcaggaaggaagcggaggtgactacatgcctatgaacaattggggctcaggaaatggccggggctcaggaggtggccagggctcaaatggccaaggctccagtagccatagctcgggaggaaaccagtgttcaggcgagggacagggatcccgaggtggtcagggctcaaatggccagggctcaggaggaaaccagtgctctagagatggccagggcaccgcaggtgggcacggttcaggtggtggccagagacctggaggtgggcatggctcaggtggtggccagggacctggagatggccatggctcaggtggtggcaagaactctggggggggcaaaggctcaggaagtgggaaaggatccgatggtgatggtgaacgtggaaaatctctgaagaaaagatcctattttggcaaattaactcaaagcaagcaacagcaaatgccaccacctccaccacctcctcctccacccccaccagctggaggaactggtggaaaagggaagtctgggggaagattcagactttatttttgtgttgacagaggagccacgaaagaatgcaaagaagccaaagaagtgaaagatgcagagatcccagaaggtgcagctcgaggtccccacagagccagagcttttgatgaagatgaggatgacccatacgtgccaatgaggccaggggtggccacccctcttgtaagctccagtgattatatgccaatggctcctcaaaatgtctctgcttcaaaaaagcgccactctcgatccccttttgaagattcaagagggtacatgatgatgtttcccagagtgagcccaccacctgctccgagtcctccaaaagcacctgatactaataaagaggatgactcaaaggacaatgacagtgagagtgactacatgtttatggctcctggagccggtgcaattccaaaaaaccccagaaatcctcagggtggctcttcctccaaaagttggagctcctacttctctctaccaaacccttttcggagctcacctttgggacagaatgacaacagtgagtatgtgccaatgttacctggaaagttcctggggaggggcctagacaaagaagtctcctataactgggaccccaaagatgcagcttcaaagccttcaggtgagggatcattctcaaagcctggagatgggggatcaccttcaaagccttcagatcatgagcccccaaagaataaagctaagagacctaaccgactttcttttattacaaaaggatataaaatcaagccaaaaccacaaaagcccacacatgagcagagagaagctgacagctctagtgactacgtcaacatggacttcactaaaagagagagcaatacaccagctccctctactcaaggactaccagattcgtggggcataattgctgaacccagacagtcagccttttctaattatgtgaatgttgagtttggagtgccatttccaaatccagcaaacgacctctcagatcttttaagagctataccacgtgccaaccccttatctctggacagtgctaggtggccacttcctccccttcccctcagtgctacaggtagcaatgctattgaggaagagggtgactacattgaagtaattttcaactcagcaatgacaccagccatggctcttgctgacagtgccattcgctatgatgctgaaacaggtcgaatctatgtggtcgacccattttctgagtgctgtatggatatttctctctcccccagccgatgttctgaaccaccacctgtagctaggctgctgcaggaagaagagcaggagagaagacgcccacaaagccgttctcaaagtttctttgcagcagccagagccgctgtctctgcttttccaacagacagcctcgagagagacctttccccatcctcagccccggctgtcgcttcggctgcagagccgactttagccctcagccaagttgtagctgcggcctccgcgctcgccgcagccccgggcatcggcgcagcagccgcagctgctggatttgactccgcctctgcccgctggtttcaacctgttgctaatgctgctgatgccgaagcagtaaggggagcccaagacgttgccggtggctcgaaccctggagcccacaacccatctgcaaaccttgccagaggtgataaccaggctggcggggctgccgctgcagctgccgctccggaaccaccacctcgcagtcgccgggtgccaagacccccggagagagaagattctgacaacgacgacgacactcacgtgagaatggattttgccagacgtgataatcagttcgactctcccaaaagaggtcggtaattttagaattaatttccctaaagtgaatggtcattgtctaatgattcgatgcgctacagtctacagtgttagggatactatttcattaa

SEQ ID NO: 2852 - DNA, 7485 bp, Homo sapiens
atgtggttaagtggcaaaagccaggtgcagaaaagaggagccgtgcgctacctgcaggcaccacctgtgaatggagaggccagcgcctgccccgcgccgccgacccacctggaccggaccacatgcgcgcggcgccggccagcccgcctcccgccgccatggggcgctgcaggcatcaggccggcgccgcgggcctctcgcgcctccttctgggcccgcttcccgccgcactgttttccttccggttgttccggaagtcgggtcctcgagggcggtgagatcggtttccgattccggggtggccgggtggcggcggcggcgctccggtcgcgatgggccagaggtgacgccgcagccgccgggagccgcgagggacggggcaggatgaaccgggccaagcccaccacggtgcgccggcccagcgccgcggccaaaccctcagggcaccctcccccaggagacttcattgctctgggctcaaagggtcaggccaatgaatcgaaaacggcgtccaccctgctgaagccagccccttccggcctgccttctgagcgcaagcgggatgcggcggccgcgttgtccagtgcctcggccctcaccggtctcaccaaacgccccaaactctcctccacaccccctctgagtgccctggggcgcctggctgaggctgcagtggcagaaaaacgagccatttctccgtcgattaaagagccatctgtggtgccaattgaagtgctgcccacggtgctgctggatgagatcgaggcggccgagctggagggcaacgatgacaggatcgagggcgtgctgtgcggggccgtgaagcagctgaaggtcacccgcgccaagcctgacagcaccctctacctgagcctcatgtacctggccaagatcaagcccaacatcttcgccactgagggcgtcattgaggctctgtgtagcctcctgcggcgggacgcctccatcaacttcaaggccaaggggaacagcctggtgtctgtgctggcctgtaacctcctcatggccgcctacgaggaggacgagaactggcccgagatctttgtcaaggtgtacatcgaggactccctgggggagcggatctgggtggacagccctcactgtaagacgtttgtggacaacatccagacggccttcaacaccagaatgccccccaggagcgtgctgctgcagggggaggcgggccgcgttgcgggcgacctgggtgcagggagcagcccacacccctccctcacggaggaggaggacagccagacggagttgctgatcgcggaggagaagctgagccccgagcaggagggccagctcatgcccaggtacgaagagctcgcggagagcgtggaggagtatgtcctggacatgctgcgggaccagctgaaccggcgccagcccatcgacaacgtctccaggaacctcctgcggctcctcacctccacctgcggctataaggaggtgcggctgctggcggtgcagaagctggagatgtggctgcagaaccccaagctgacccggccggcccaggacctgctgatgtccgtctgcatgaactgcaacacgcacggttccgaagacatggacgtcatctcacacctgatcaagatccgcctcaagcccaaggtcctcctcaaccacttcatgctgtgcatcagggagctgctgagcgcgcacaaggacaacctgggcaccaccatcaagttggtgatcttcaatgagctctccagcgcccggaacccgaacaacatgcaggtcctctataccgcactgcagcacagctcagagctggcgcccaagttcctggccatggtgttccaggacctgctgaccaacaaggacgactacctgcgggcctcgcgggccctgctgcgggagatcatcaagcagaccaagcacgagatcaacttccaggccttctgcctggggctcatgcaggagcgcaaggagccgcagtacctggagatggagttcaaggagcgcttcgtggtgcacatcaccgacgtcctggccgtgtccatgatgctgggcatcacagcgcaggtgaaggaggccggcatcgcctgggacaaaggagaaaagaggaacctggaagtgctccgctcattccagaaccagattgccgccatccagcgggatgccgtctggtggctccacactgtggtcccctccatcagcaagctcgcccctaaggactacgtgcactgcctgcacaaggtgctgttcacagagcagccggagacctactacaagtgggacaactggccacccgagagtgaccgcaacttcttcctgcgtctgtgctccgaggtgcccattttggaggacacgctgatgcgcatcctggtcatcgggctgtcccgggagctcccgctcgggcctgcggacgccatggagcttgctgaccacctggtgaagcgggcggctgccgtgcaggcggatgatgtggaggtgctgaaggtggggaggacccagctgatcgacgccgttctgaatctgtgcacctaccatcaccctgaaaacatccagctcccaccggggtaccagcctccgaacctcgccatctctaccctctactggaaggcctggcccctcctgctggtcgtcgccgcattcaacccagagaacatcggcctggctgcgtgggaggagtacccgaccctgaagatgctcatggagatggtgatgaccaacaactactcctacccaccgtgcaccctgacggatgaggagacccggacggagatgctgaaccgtgagctgcagaccgcccagcgggagaagcaggagatcctggccttcgaggggcacctggcggccgcgtccaccaagcagaccatcactgagagcagcagcctcctcctgtcgcagctcaccagcctggacccccagtacgcagcccacacagccccgccctgcgcctgccgtcgggacctggggcccccccggaggcctccccctcacatcctggatcaagtgaaaagcctcaaccagtccctccgcctcgggcacctcttgtgccgcagccgaaaccctgactttctcctccacatcatccagcggcaggcctcctcgcagtccatgccctggctggcggacctggtacagtccagcgagggctccctggacgtgctgcccgtgcagtgtctgtgcgagttcctgctgcacgatgctgtggacgatgctgcttccggggaggaggacgacgagggcgagagcaaggagcagaaggccaagaagcggcagaggcaacagaagcagcggcagctgctgggccgcctgcaggacctgctactgggcccgaaggctgatgagcagaccacgtgtgaggtgctggactacttcttgcggcgcctcggctcctcccaggtggcctcccgcgtgctggccatgaagggtgagaccctgcctgcactgccgaaagccggcccagctcatgagtgtctgccacagggtttgtcgctggtgctttcggagggcagcctgcgggacggggaggagaaggagccccccatggaggaggatgtgggggacacagatgtgctgcagggctatcagtggctgctgcgggacctgcctcgcctgcctctgttcgacagcgtcaggagcaccacagccctggccctgcagcaggcaatccacatggagactgatccccagaccatcagcgcctacctgatctacttgtcccagcacacgcctgtggaggagcaggcccagcacagcgacctggccctggacgtggcccggctggtcgtggagcgctccaccatcatgtcccacctcttctcgaagctctccccgagtgccgcgtcggacgccgtgctgagcgctctgttgtccatcttctcacgctacgtgaggcgcatgcggcagagcaaggagggcgaggaggtctacagctggtcggagtctcaggaccaggtcttcctacgctggagcagcggggagacagccaccatgcacatcctcgtggtccatgccatggtgatcctgctgacgctgggcccgcctcgagccgacgacagcgagttccaggcgctgctggacatctggtttccggaggagaagccactgcccaccgccttcctggtggacacatcggaggaggcgctgctgcttcctgactggctgaagctgcgcatgatccgttctgaggtgctccgcctggtggacgccgccctgcaggacctggagccgcagcagctgctgctgttcgtgcagtcgtttggcatccccgtgtccagcatgagcaaactcctccagttcctggaccaggcagtggcccacgacccccagactctggagcagaacatcatggacaagagtaagatgccagggacctgcggagtgggttcacacacgctgaccgagccccagcccggccaggcttttggggcctgggtgcgagcgggtgtgaccctgctacggtttgcagattacatggcccacctggtggaggtccagcatgagcgcggcgcctccggaggccagactttccactccttgctcacagcctccctgccgccccgccgagacagcacagaggcacccaaaccaaagagcagcccagagcagcccataggccagggccggattcgggtggggacccagctccgggtgctgggccctgaggacgacctggctggcatgttcctccagattttcccgctcagcccggaccctcggtggcagagctccagtccccgccccgtggccctcgccctgcagcaggccctgggccaggagctggcccgcgtcgtccagggcagccccgaggtgccgggcatcacggtgcgtgtcctgcaggccctcgccaccctgctcagctccccacacggcggtgccctggtgatgtccatgcaccgtagccacttcctggcctgcccgctgctgcgccagctctgccagtaccagcgctgtgtgccacaggacaccggcttctcctcgctcttcctgaaggtgctcctgcagatgctgcagtggctggacagccctggcgtggagggcgggcccctgcgggcacagctcaggatgcttgccagccaggcctcagccgggcgcaggctcagtgatgtgcgaggggggctcctgcgcctggccgaggccctggccttccgtcaggacctggaggtggtcagctccaccgtccgtgccgtcatcgccaccctgaggtctggggagcagtgcagcgtggagccggacctgatcagcaaagtcctccaggggctgatcgaggtgaggtccccccacctggaggagctgctgactgcattcttctctgccactgcggatgctgcctccccgtttccagcctgtaagcccgttgtggtggtgagctccctgctgctgcaggaggaggagcccctggctggggggaagccgggtgcggacggtggcagcctggaggccgtgcggctggggccctcgtcaggcctcctagtggactggctggaaatgctggaccccgaggtggtcagcagctgccccgacctgcagctcaggctgctcttctcccggaggaagggcaaaggtcaggcccaggtgccctcgttccgtccctacctcctgaccctcttcacgcatcagtccagctggcccacactgcaccagtgcatccgagtcctgctgggcaagagccgggaacagaggttcgacccctctgcctctctggacttcctctgggcctgcatccatgttcctcgcatctggcaggggcgggaccagcgcaccccgcaggcaggtcttgggaggaagcggcgggaggagctggtgctgcgggtccagggcccggagctcatcagcctggtggagctgatcctggccgaggcggagacgcggagccaggacggggacacagccgcctgcagcctcatccaggcccggctgcccctgctgctcagctgctgctgtggggacgatgagagtgtcaggaaggtgacggagcacctgtcaggctgcatccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatgccagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggaggatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtc

SEQ ID NO: 2853 - DNA, 6959 bp, Homo sapiens
gtggccgggtggcggcggcggcgctccggtcgcgatgggccagaggtgacgccgcagccgccgggagccgcgagggacggggcaggatgaaccgggccaagcccaccacggtgcgccggcccagcgccgcggccaaaccctcagggcaccctcccccaggagacttcattgctctgggctcaaagggtcaggccaatgaatcgaaaacggcgtccaccctgctgaagccagccccttccggcctgccttctgagcgcaagcgggatgcggcggccgcgttgtccagtgcctcggccctcaccggtctcaccaaacgccccaaactctcctccacaccccctctgagtgccctggggcgcctggctgaggctgcagtggcagaaaaacgagccatttctccgtcgattaaagagccatctgtggtgccaattgaagtgctgcccacggtgctgctggatgagatcgaggcggccgagctggagggcaacgatgacaggatcgagggcgtgctgtgcggggccgtgaagcagctgaaggtcacccgcgccaagcctgacagcaccctctacctgagcctcatgtacctggccaagatcaagcccaacatcttcgccactgagggcgtcattgaggctctgtgtagcctcctgcggcgggacgcctccatcaacttcaaggccaaggggaacagcctggtgtctgtgctggcctgtaacctcctcatggccgcctacgaggaggacgagaactggcccgagatctttgtcaaggtgtacatcgaggactccctgggggagcggatctgggtggacagccctcactgtaagacgtttgtggacaacatccagacggccttcaacaccagaatgccccccaggagcgtgctgctgcagggggaggcgggccgcgttgcgggcgacctgggtgcagggagcagcccacacccctccctcacggaggaggaggacagccagacggagttgctgatcgcggaggagaagctgagccccgagcaggagggccagctcatgcccaggtacgaagagctcgcggagagcgtggaggagtatgtcctggacatgctgcgggaccagctgaaccggcgccagcccatcgacaacgtctccaggaacctcctgcggctcctcacctccacctgcggctataaggaggtgcggctgctggcggtgcagaagctggagatgtggctgcagaaccccaagctgacccggccggcccaggacctgctgatgtccgtctgcatgaactgcaacacgcacggttccgaagacatggacgtcatctcacacctgatcaagatccgcctcaagcccaaggtcctcctcaaccacttcatgctgtgcatcagggagctgctgagcgcgcacaaggacaacctgggcaccaccatcaagttggtgatcttcaatgagctctccagcgcccggaacccgaacaacatgcaggtcctctataccgcactgcagcacagctcagagctggcgcccaagttcctggccatggtgttccaggacctgctgaccaacaaggacgactacctgcgggcctcgcgggccctgctgcgggagatcatcaagcagaccaagcacgagatcaacttccaggccttctgcctggggctcatgcaggagcgcaaggagccgcagtacctggagatggagttcaaggagcgcttcgtggtgcacatcaccgacgtcctggccgtgtccatgatgctgggcatcacagcgcaggtgaaggaggccggcatcgcctgggacaaaggagaaaagaggaacctggaagtgctccgctcattccagaaccagattgccgccatccagcgggatgccgtctggtggctccacactgtggtcccctccatcagcaagctcgcccctaaggactacgtgcactgcctgcacaaggtgctgttcacagagcagccggagacctactacaagtgggacaactggccacccgagagtgaccgcaacttcttcctgcgtctgtgctccgaggtgcccattttggaggacacgctgatgcgcatcctggtcatcgggctgtcccgggagctcccgctcgggcctgcggacgccatggagcttgctgaccacctggtgaagcgggcggctgccgtgcaggcggatgatgtggaggtgctgaaggtggggaggacccagctgatcgacgccgttctgaatctgtgcacctaccatcaccctgaaaacatccagctcccaccggggtaccagcctccgaacctcgccatctctaccctctactggaaggcctggcccctcctgctggtcgtcgccgcattcaacccagagaacatcggcctggctgcgtgggaggagtacccgaccctgaagatgctcatggagatggtgatgaccaacaactactcctacccaccgtgcaccctgacggatgaggagacccggacggagatgctgaaccgtgagctgcagaccgcccagcgggagaagcaggagatcctggccttcgaggggcacctggcggccgcgtccaccaagcagaccatcactgagagcagcagcctcctcctgtcgcagctcaccagcctggacccccaggggcccccccggaggcctccccctcacatcctggatcaagtgaaaagcctcaaccagtccctccgcctcgggcacctcttgtgccgcagccgaaaccctgactttctcctccacatcatccagcggcaggcctcctcgcagtccatgccctggctggcggacctggtacagtccagcgagggctccctggacgtgctgcccgtgcagtgtctgtgcgagttcctgctgcacgatgctgtggacgatgctgcttccggggaggaggacgacgagggcgagagcaaggagcagaaggccaagaagcggcagaggcaacagaagcagcggcagctgctgggccgcctgcaggacctgctactgggcccgaaggctgatgagcagaccacgtgtgaggtgctggactacttcttgcggcgcctcggctcctcccaggtggcctcccgcgtgctggccatgaagggtttgtcgctggtgctttcggagggcagcctgcgggacggggaggagaaggagccccccatggaggaggatgtgggggacacagatgtgctgcagggctatcagtggctgctgcgggacctgcctcgcctgcctctgttcgacagcgtcaggagcaccacagccctggccctgcagcaggcaatccacatggagactgatccccagaccatcagcgcctacctgatctacttgtcccagcacacgcctgtggaggagcaggcccagcacagcgacctggccctggacgtggcccggctggtcgtggagcgctccaccatcatgtcccacctcttctcgaagctctccccgagtgccgcgtcggacgccgtgctgagcgctctgttgtccatcttctcacgctacgtgaggcgcatgcggcagagcaaggagggcgaggaggtctacagctggtcggagtctcaggaccaggtcttcctacgctggagcagcggggagacagccaccatgcacatcctcgtggtccatgccatggtgatcctgctgacgctgggcccgcctcgagccgacgacagcgagttccaggcgctgctggacatctggtttccggaggagaagccactgcccaccgccttcctggtggacacatcggaggaggcgctgctgcttcctgactggctgaagctgcgcatgatccgttctgaggtgctccgcctggtggacgccgccctgcaggacctggagccgcagcagctgctgctgttcgtgcagtcgtttggcatccccgtgtccagcatgagcaaactcctccagttcctggaccaggcagtggcccacgacccccagactctggagcagaacatcatggacaagaattacatggcccacctggtggaggtccagcatgagcgcggcgcctccggaggccagactttccactccttgctcacagcctccctgccgccccgccgagacagcacagaggcacccaaaccaaagagcagcccagagcagcccataggccagggccggattcgggtggggacccagctccgggtgctgggccctgaggacgacctggctggcatgttcctccagattttcccgctcagcccggaccctcggtggcagagctccagtccccgccccgtggccctcgccctgcagcaggccctgggccaggagctggcccgcgtcgtccagggcagccccgaggtgccgggcatcacggtgcgtgtcctgcaggccctcgccaccctgctcagctccccacacggcggtgccctggtgatgtccatgcaccgtagccacttcctggcctgcccgctgctgcgccagctctgccagtaccagcgctgtgtgccacaggacaccggcttctcctcgctcttcctgaaggtgctcctgcagatgctgcagtggctggacagccctggcgtggagggcgggcccctgcgggcacagctcaggatgcttgccagccaggcctcagccgggcgcaggctcagtgatgtgcgaggggggctcctgcgcctggccgaggccctggccttccgtcaggacctggaggtggtcagctccaccgtccgtgccgtcatcgccaccctgaggtctggggagcagtgcagcgtggagccggacctgatcagcaaagtcctccaggggctgatcgaggtgaggtccccccacctggaggagctgctgactgcattcttctctgccactgcggatgctgcctccccgtttccagcctgtaagcccgttgtggtggtgagctccctgctgctgcaggaggaggagcccctggctggggggaagccgggtgcggacggtggcagcctggaggccgtgcggctggggccctcgtcaggcctcctagtggactggctggaaatgctggaccccgaggtggtcagcagctgccccgacctgcagctcaggctgctcttctcccggaggaagggcaaaggtcaggcccaggtgccctcgttccgtccctacctcctgaccctcttcacgcatcagtccagctggcccacactgcaccagtgcatccgagtcctgctgggcaagagccgggaacagaggttcgacccctctgcctctctggacttcctctgggcctgcatccatgttcctcgcatctggcaggggcgggaccagcgcaccccgcagaagcggcgggaggagctggtgctgcgggtccagggcccggagctcatcagcctggtggagctgatcctggccgaggcggagacgcggagccaggacggggacacagccgcctgcagcctcatccaggcccggctgcccctgctgctcagctgctgctgtggggacgatgagagtgtcaggaaggtgacggagcacctgtcaggctgcatccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatgccagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggaggatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtc

SEQ ID NO: 2854 - DNA, 5802 bp, Homo sapiens
aaggatcaacaaacagtaataatgactgaatgtacaagtcttcagtttgtcagcccttttgcttttgaggcaatgcagaaggtggatgttgtttgcctggcatctttaagtgatccagaattaagacttcttctgccctgtttggtacggatggcactttgtgcacctgctgaccagagccaaagctgggctcaggataagaaactcatccttcgccttctttctggagtggaagctgtcaactccattgttgcattgttgtccgtggactttcatgctttagaacaagatgccagcaaagaacagcagcttaggcataaacttggaggaggcagtggagagagcatcctggtatcacagcttcagcatggactgacgttagagtttgaacacagtgattcacctcgtcgattgcgtcttgtgcttagtgaactgttggcaattatgaacaaggtgtctgagtccaacggagaattttttttcaagtcttctgaactttttgagagtccagtatatttggaggaagctgcagatgtactttgtattttacaagcagagctcccttccttgctccctatagttgatgtagctgaagctttgctacatgttagaaatggtgcctggttcttgtgtctcttggtggccaatgttcctgatagttttaatgaagtttgtaggggcctgataaaaaatggagaacgacaagatgaagaaagtcttggaggaaggcgcaggacagatgccttacgcttcttgtgtaaaatgaatccttctcaggccctcaaggtccgaggcatggtggtggaagaatgtcacttgccaggccttggtgtggctttgacattggatcatactaaaaatgaagcttgtgaggatggagtgagtgacttggtttgttttgtaagtggtttgcttcttggaacaaatgcgaaagtccggacttggtttggaacttttatccgaaatggacagcagagaaaaagagagaccagcagttctgtcctttggcagatgagaaggcagcttcttctggagttgatgggcattcttcccacagtaagaagcacccgaattgtggaagaagctgatgtggatatggagcccaatgtgtctgtgtattcggggctgaaagaagagcatgttgtgaaagccagtgcactcttacgtctgtactgtgctttgatggggatcgctggactcaaaccaactgaagaagaagctgagcaattactgcagttgatgacgagccgtcctcctgctacgccagctggggttcgctttgtttcactttccttttgtatgctactggccttttctacacttgtcagtacacctgaacaggagcagctgatggtggtgtggctaagttggatgataaaagaagaagcgtattttgagagtacttcaggcgtctctgcttcttttggggagatgttattattggtggctatgtactttcacagcaaccagcttagtgctatcattgacttggtctgttccactttggggatgaagattgtaattaagccaagctccttgagcaggatgaagacaatcttcacacaggaaatttttactgagcaggttgtcacagctcatgcagttcgggtccctgtcaccagcaacctgagtgccaacattactggatttttgcctattcattgtatttaccagcttctcaggagccgttcctttaccaagcacaaagtgtcaataaaagattggatttatagacagctgtgtgaaacctctactccacttcatcctcaattacttcctttgattgatgtgtacataaattctatacttactcctgcgtcgaaatctaatccagaagccacaaatcagccagtcacagaacaggagatactcaatattttccaaggagtcattgggggtgacaacatccgccttaatcagcgtttcagtatcacagcacagcttttggtgctctactatatactgtcttatgaagaggctcttctagcaaacacgaagactttagctgccatgcaaagaaagcccaaatcatattcttcttctttaatggatcagattcctatcaaattccttattcgacaggctcaagggctgcagcaggagttgggagggttgcattcagctttactacgtctccttgctactaactacccacatttatgtattgtggatgactggatttgtgaagaagaaatcacagggactgatgccctgctacggcgaatgctcctgactaataatgctaaaaatcattctcccaaacaactccaagaagcattttcagctgtcccagtaaataacacacaagtgatgcagattatagaacacttgactctactctctgccagtgaacttataccatatgcggaagtgttaacatccaatatgagccagctattgaattcaggggttccacggagaattctgcaaacagtcaataaactatggatggttcttaatactgtgatgcctagaaggctatgggtaatgacggttaatgcacttcagccttcaataaagtttgtacgacaacaaaagtatactcagaatgacctgatgatagatcctctcattgtcctaaggtgtgatcagagggttcacagatgccccccactgatggatattaccctacacatgttgaatggatatcttcttgcatctaaagcctaccttagtgctcatctgaaggaaacagagcaagataggccttcccagaataatacaattggtttagttggacaaactgatgctccggaagttaccagggaagaattgaaaaatgcattactggccgctcaggatagtgcagctgtccagattctcttagagatttgcctacctactgaagaggagaaagcaaatggtgtcaatccagatagcttgttaagaaatgttcaaagtgttattaccaccagcgctccaaataagggaatggaggaaggagaagacaatttgctctgtaaccttcgagaagttcagtgccttatctgttgtctcttgcaccaaatgtacattgcagatcccaacattgctaagcttgttcactttcagggttatccatgtgaacttttgcctctgacggtcgcaggtattccatctatgcacatctgtctagatttcatacctgagcttattgcacagccagaacttgagaaacagatatttgctatccagttgctttctcacttgtgtatacaatatgcattaccaaagtcacttagtgtggctcgtttagctgtcaatgtcatgggaactttgttaacagttttaacacaggctaagcggtatgctttttttatgccaactctgccaagtttggtctctttttgtcgagcatttcctccattgtatgaggatattatgtctttgctgatccaaatagggcaagtttgtgcctctgatgttgccactcagacaagagacattgatccaattattacacgtcttcaacaaataaaggagaaaccaagtggatggtctcaaatctgtaaagattcatcttataaaaatggatccagggacactggaagcatggatcctgatgtacagctctgtcactgtattgaaagaacagtaattgaaataataaatatgagtgttagtggaatttaaaacaaaatttaaaacaacaaaaagttgtttgctgcatatacccaacatgaatctgcatattagtaacaactctaaactgaatgggaacagtaaagtattgtcttggaatcactaaaacaattcaattcaacatgagtatagtttagaactttatgagaattatgcttgcttgtttctgattggcacatctttggatctactttgctgatatgtttctattgtagcagctgagctttttttttttccactgggaacacatgtaagaaactcattattggaaagggaatttggccttgtatttagcttttgaagtgaagactgccatgcctttaatttcttataaaaatgagtctgtgggtagccctagtgtttattttaactgtgagcttgtaacagaatgtgacaaagatgcaaagatgggagaggaaaaaagggtaaagggaaaggagaattaaggaaataataggagttaaaaacacaagtagaaatctcaaagatttgcagtgcaagtaatagtaatgcaagttggaattctagttctcaagaaagagtattgagaagacttttaaaaaggcaagtagcttttgtaaatgatttctgtggaaatacagatgaggatttaaagatttcacatatttgcttcaatttttattaatatatgaagccatatgtttaaagagatacttgaataatttggaattttaagatactggtgtaaaagtgtttacagaaacatctttgttcaaagaagaacctgagagatctcatttagttttatgttttaaatttatttttataatgctttattaacttacctaatgctcagaggggggaaatatgtatcaaattaaatgaaggtagagcaataaaacccactggattaaagagctcttggtttgtcatcaggattataattcatatcttactttgagaagatctttgagtaagaaaatgcagtgtttgaacctgaggaaaagttaaagtgtagaaaatattgtcttgccgaaggattttgcagtcctctgtcagtaacttccattgattaggcagacatattcaggtaaaccctaatcattaaaaaaaaattatcaatgtagaaagtaattcccttttttctctctgagatatacctcaatcacacacttccccacccccacttgaaacagacctcttcacttgtgttttttttttttttttcctgaggtggagtcttcccctgttgcccaggctggagtgcagtgggatgatcttggctcactgcaacttctgccacctgggttcaagggattctcgtgcctcaacctcctgagtagctgggactgcaggcacgcgccacctgtatttttgtatttttagtaaagacgggggtttgccatgttgcccagactggttttgaactcctggcctcaggtgatctgcccaccttggcctcccaaagtgctgggattacaggtgtgagccaccgcacctggccagaccgcttcacttgtaaaagaaattaggctaataagaaggtgtagtttttgagaaatgaaatttaactttagccttttcactagtaaatagtcacatctcattttcttcctttgtaaaatggggttactactggccctacctcatattctatgagaatgagtttgtagctgtttcaaatcatgaagtgcatagtatcacatgtgatagaatatttataactttttattagatgcttaatgttcaattaagtaattttgatgtgaaaaataaaagtaataaaagtatcttaaaaatagcataagaattttcatatttttaaacaaggcagttttgtagtcccttaagattaaatacaactgctccttttttttttaaactgaggccttgcgatattttgtgtgaatagatatgccctaggagttcagaaaaagttaaaagtatgttttctaattaaatgcagtgcacattcctggatcaatattcaaagactggtcataacctgctgtgttaaaataatcacatatgctctttttcatcagatttgttgatgatgtaaataaaatgtgtaaatatattagtaaatgttaatattcatgtattttaagttaaggttataaaatttgtcacaatgtgtttttttattcaagtgaaaacagatgtgtgcagctattttgaatattggtttataaacattcatattctttatcaaacgaa

SEQ ID NO: 2855 - DNA, 5881 bp, Homo sapiens
ctctgcctttcctctcgcagccacccttcctctcagaccagtacggtggccgacgggagtcagacgctggggatgaatgaaggatcaacaaacagtaataatgactgaatgtacaagtcttcagtttgtcagcccttttgcttttgaggcaatgcagaaggtggatgttgtttgcctggcatctttaagtgatccagaattaagacttcttctgccctgtttggtacggatggcactttgtgcacctgctgaccagagccaaagctgggctcaggataagaaactcatccttcgccttctttctggagtggaagctgtcaactccattgttgcattgttgtccgtggactttcatgctttagaacaagatgccagcaaagaacagcagcttaggcataaacttggaggaggcagtggagagagcatcctggtatcacagcttcagcatggactgacgttagagtttgaacacagtgattcacctcgtcgattgcgtcttgtgcttagtgaactgttggcaattatgaacaaggtgtctgagtccaacggagaattttttttcaagtcttctgaactttttgagagtccagtatatttggaggaagctgcagatgtactttgtattttacaagcagagctcccttccttgctccctatagttgatgtagctgaagctttgctacatgttagaaatggtgcctggttcttgtgtctcttggtggccaatgttcctgatagttttaatgaagtttgtaggggcctgataaaaaatggagaacgacaagatgaagaaagtcttggaggaaggcgcaggacagatgccttacgcttcttgtgtaaaatgaatccttctcaggccctcaaggtccgaggcatggtggtggaagaatgtcacttgccaggccttggtgtggctttgacattggatcatactaaaaatgaagcttgtgaggatggagtgagtgacttggtttgttttgtaagtggtttgcttcttggaacaaatgcgaaagtccggacttggtttggaacttttatccgaaatggacagcagagaaaaagagagaccagcagttctgtcctttggcagatgagaaggcagcttcttctggagttgatgggcattcttcccacagtaagaagcacccgaattgtggaagaagctgatgtggatatggagcccaatgtgtctgtgtattcggggctgaaagaagagcatgttgtgaaagccagtgcactcttacgtctgtactgtgctttgatggggatcgctggactcaaaccaactgaagaagaagctgagcaattactgcagttgatgacgagccgtcctcctgctacgccagctggggttcgctttgtttcactttccttttgtatgctactggccttttctacacttgtcagtacacctgaacaggagcagctgatggtggtgtggctaagttggatgataaaagaagaagcgtattttgagagtacttcaggcgtctctgcttcttttggggagatgttattattggtggctatgtactttcacagcaaccagcttagtgctatcattgacttggtctgttccactttggggatgaagattgtaattaagccaagctccttgagcaggatgaagacaatcttcacacaggaaatttttactgagcaggttgtcacagctcatgcagttcgggtccctgtcaccagcaacctgagtgccaacattactggatttttgcctattcattgtatttaccagcttctcaggagccgttcctttaccaagcacaaagtgtcaataaaagattggatttatagacagctgtgtgaaacctctactccacttcatcctcaattacttcctttgattgatgtgtacataaattctatacttactcctgcgtcgaaatctaatccagaagccacaaatcagccagtcacagaacaggagatactcaatattttccaaggagtcattgggggtgacaacatccgccttaatcagcgtttcagtatcacagcacagcttttggtgctctactatatactgtcttatgaagaggctcttctagcaaacacgaagactttagctgccatgcaaagaaagcccaaatcatattcttcttctttaatggatcagattcctatcaaattccttattcgacaggctcaagggctgcagcaggagttgggagggttgcattcagctttactacgtctccttgctactaactacccacatttatgtattgtggatgactggatttgtgaagaagaaatcacagggactgatgccctgctacggcgaatgctcctgactaataatgctaaaaatcattctcccaaacaactccaagaagcattttcagctgtcccagtaaataacacacaagtgatgcagattatagaacacttgactctactctctgccagtgaacttataccatatgcggaagtgttaacatccaatatgagccagctattgaattcaggggttccacggagaattctgcaaacagtcaataaactatggatggttcttaatactgtgatgcctagaaggctatgggtaatgacggttaatgcacttcagccttcaataaagtttgtacgacaacaaaagtatactcagaatgacctgatgatagatcctctcattgtcctaaggtgtgatcagagggttcacagatgccccccactgatggatattaccctacacatgttgaatggatatcttcttgcatctaaagcctaccttagtgctcatctgaaggaaacagagcaagataggccttcccagaataatacaattggtttagttggacaaactgatgctccggaagttaccagggaagaattgaaaaatgcattactggccgctcaggatagtgcagctgtccagattctcttagagatttgcctacctactgaagaggagaaagcaaatggtgtcaatccagatagcttgttaagaaatgttcaaagtgttattaccaccagcgctccaaataagggaatggaggaaggagaagacaatttgctctgtaaccttcgagaagttcagtgccttatctgttgtctcttgcaccaaatgtacattgcagatcccaacattgctaagcttgttcactttcagggttatccatgtgaacttttgcctctgacggtcgcaggtattccatctatgcacatctgtctagatttcatacctgagcttattgcacagccagaacttgagaaacagatatttgctatccagttgctttctcacttgtgtatacaatatgcattaccaaagtcacttagtgtggctcgtttagctgtcaatgtcatgggaactttgttaacagttttaacacaggctaagcggtatgctttttttatgccaactctgccaagtttggtctctttttgtcgagcatttcctccattgtatgaggatattatgtctttgctgatccaaatagggcaagtttgtgcctctgatgttgccactcagacaagagacattgatccaattattacacgtcttcaacaaataaaggagaaaccaagtggatggtctcaaatctgtaaagattcatcttataaaaatggatccagggacactggaagcatggatcctgatgtacagctctgtcactgtattgaaagaacagtaattgaaataataaatatgagtgttagtggaatttaaaacaaaatttaaaacaacaaaaagttgtttgctgcatatacccaacatgaatctgcatattagtaacaactctaaactgaatgggaacagtaaagtattgtcttggaatcactaaaacaattcaattcaacatgagtatagtttagaactttatgagaattatgcttgcttgtttctgattggcacatctttggatctactttgctgatatgtttctattgtagcagctgagctttttttttttccactgggaacacatgtaagaaactcattattggaaagggaatttggccttgtatttagcttttgaagtgaagactgccatgcctttaatttcttataaaaatgagtctgtgggtagccctagtgtttattttaactgtgagcttgtaacagaatgtgacaaagatgcaaagatgggagaggaaaaaagggtaaagggaaaggagaattaaggaaataataggagttaaaaacacaagtagaaatctcaaagatttgcagtgcaagtaatagtaatgcaagttggaattctagttctcaagaaagagtattgagaagacttttaaaaaggcaagtagcttttgtaaatgatttctgtggaaatacagatgaggatttaaagatttcacatatttgcttcaatttttattaatatatgaagccatatgtttaaagagatacttgaataatttggaattttaagatactggtgtaaaagtgtttacagaaacatctttgttcaaagaagaacctgagagatctcatttagttttatgttttaaatttatttttataatgctttattaacttacctaatgctcagaggggggaaatatgtatcaaattaaatgaaggtagagcaataaaacccactggattaaagagctcttggtttgtcatcaggattataattcatatcttactttgagaagatctttgagtaagaaaatgcagtgtttgaacctgaggaaaagttaaagtgtagaaaatattgtcttgccgaaggattttgcagtcctctgtcagtaacttccattgattaggcagacatattcaggtaaaccctaatcattaaaaaaaaattatcaatgtagaaagtaattcccttttttctctctgagatatacctcaatcacacacttccccacccccacttgaaacagacctcttcacttgtgttttttttttttttttcctgaggtggagtcttcccctgttgcccaggctggagtgcagtgggatgatcttggctcactgcaacttctgccacctgggttcaagggattctcgtgcctcaacctcctgagtagctgggactgcaggcacgcgccacctgtatttttgtatttttagtaaagacgggggtttgccatgttgcccagactggttttgaactcctggcctcaggtgatctgcccaccttggcctcccaaagtgctgggattacaggtgtgagccaccgcacctggccagaccgcttcacttgtaaaagaaattaggctaataagaaggtgtagtttttgagaaatgaaatttaactttagccttttcactagtaaatagtcacatctcattttcttcctttgtaaaatggggttactactggccctacctcatattctatgagaatgagtttgtagctgtttcaaatcatgaagtgcatagtatcacatgtgatagaatatttataactttttattagatgcttaatgttcaattaagtaattttgatgtgaaaaataaaagtaataaaagtatcttaaaaatagcataagaattttcatatttttaaacaaggcagttttgtagtcccttaagattaaatacaactgctccttttttttttaaactgaggccttgcgatattttgtgtgaatagatatgccctaggagttcagaaaaagttaaaagtatgttttctaattaaatgcagtgcacattcctggatcaatattcaaagactggtcataacctgctgtgttaaaataatcacatatgctctttttcatcagatttgttgatgatgtaaataaaatgtgtaaatatattagtaaatgttaatattcatgtattttaagttaaggttataaaatttgtcacaatgtgtttttttattcaagtgaaaacagatgtgtgcagctattttgaatattggtttataaacattcatattctttatcaaacgaa

SEQ ID NO: 2856 - DNA, 3285 bp, Homo sapiens
atgcgccgcctgcgctccgccgctcgcgcctcgggctcggctcgggctccgggatgtccgcgctgtgcgaccctcccggggccccagggccacctgggcctgccccggccacccacggtcccgcgcctctcagtgctcaggagctgtcccaggaaatcaaggcttttctgactggcgtagaccccattctgggccaccaactctcagcccgggaacatgctcgctgtggtcttctcctgctccgttctttgccacctgctcgggctgctgtgcttgaccacttgagaggtgtctttgatgagagtgtccgggcccacctggctgccctggatgaaacccctgtggctggtccacctcacctccgtccacctccaccctctcatgtccctgctggtggacctggtctagaggatgtggttcaggaagtgcagcaggtgctgtctgagtttatccgggccaacccaaaggcctgggcacctgtgattagtgcatggtccattgacctcatggggcaactgagcagcacgtactcaggccagcaccagcgtgttccccacgctactggcgctcttaatgaactgctacagctgtggatgggttgtagggccacgcgtacattaatggacatctatgtgcagtgcctctcggctctcattggtagctgcccagatgcgtgtgtggatgccttgctggatacctctgttcagcattctccacactttgactgggttgtggcacatattggctcctcttttcctggcaccatcatttcccgggttctctcctgtggccttaaggacttttgtgtccatggtggggctggaggtggagctggcagtagtggtggaagctcttctcagaccccctctacagaccccttccctggatctcctgccattcctgcggagaaacgggtgcccaagattgcctcagttgtaggcatcctaggtcacctggcctcccgccacggagatagcatccgacgggagctcctgcgaatgttccatgatagcctggcagggggatctggaggccgcagtggggacccctcccttcaggccacggttccgttcctactgcagctggcagtcatgtcaccagctttgctgggcactgtctctggagagcttgtggattgcctcaagcccccagctgtgctgagccagctgcagcaacaccttcaaggattcccccgagaggagctggacaacatgttgaacctggctgtgcacctggtgagccaggcctctggggcaggtgcctaccgcttgctgcagttcctggtggacacagctatgcctgcttcggtcattaccacccagggcctggctgtgccagacaccgtgcgtgaggcttgtgaccggctaatccagctgctgctgctgcacctgcaaaaactggttcatcaccggggagggtctcctggggaaggggtgctaggcccgcccccacctccccgcttggtgccctttttagatgcgctcaaaaaccatgttggagagctgtgtggagagacgttacgattggaacggaagcgcttcctctggcagcaccagctcttgggcctgctgtctgtctatacccggcctagctgtggacctgaggccttgggccatctgctgagccgagcccgaagccctgaagagttgagtttggccacccagttatatgcagggctagtggtcagcctctctggcctcctgcccctggctttccgaagctgtctggctcgggtgcatgcagggacattacagcctcccttcacggcccggttcctgcgcaacttggcactgctagtagggtgggaacagcagggtggcgagggccctgcagccctaggggcgcactttggggaatctgcctcagcccatctgtctgacctggctcctctcctgctacatcctgaggaggaagtagctgaagctgctgcctctctcctggccatttgtccctttccttctgaagccttatccccctcccagctcctgggactggtaagggctggggtgcaccgcttctttgcctctctgaggctgcatggacccccaggtgtggcctcagcctgtcagcttctcacccgcctgtctcagacatccccagctgggctcaaggctgtcctgcagctgctggttgaaggagccttacatcgaggcaacacagaactgtttggtgggcaagtagatggggacaatgagactctctcagttgtttcagcttctttggcttctgcctccctgttggacactaaccggaggcacactgcagctgtgccaggtcctggagggatttggtcagttttccatgctggagtcatcggccgtggcttaaagccacccaagtttgtccagtcacgaaatcagcaggaagtgatctataacacccagagcctcctcagcctcctggttcactgctgcagtgccccagggggcactgaatgtggggaatgctggggggcacccatcttgagtccagaggcagccaaagcagtggcagtgaccttggtggagagtgtgtgtcccgatgcagctggtgcagagctggcctggccccccgaggaacacgcccgggccaccgtggagcgggatctccgcattggccggcgcttccgcgaacagcccctgctctttgagctgttaaagctggtagcagctgcacccccagccctgtgctactgttccgtgctgcttcgggggctgctggccgccctcttgggccattgggaagcctctcgccaccctgacacgacccactccccctggcacctggaggcatcctgcaccttagtggctgtcatggctgagggaagcctcctgcctccggccctgggtaatatgcatgaagtatttagccaactggcacctttcgaggtgcgtctgctgctgctcagtgtctggggttttctccgggagcatgggcccttgcctcagaagttcatcttccaatcagagcggggtcgcttcattcgggacttctccagggagggtggaggtgagggtggaccccatctggctgtgctgcacagtgtcctccaccgcaacatcgaccgcctaggtcttttctctggccgtttccaggcaccttcaccgtccactctccttcgacaggggacgtagccttttcttgctctggaagcccagggaggttgagcagtgagagagggaagggactaacgtgctccggaagggtggaggtttctcttctaagtccttggtctaaagagcgctgtcacttttttctctcccacttttttttttctaaataaaatttgccaacttgagaaaacca

SEQ ID NO: 2857 - DNA, 2901 bp, Homo sapiens
ccgcggcggcaggtccacctgggcttgcgaaggcacagattccccgtccacagctcacgaccagatgcaccagcaggagtccacatcgaggacgtcctccgggcactcccacgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggtgcgggaccttgtcccaagcagcagggtggtccgcctgggtgagggtgggccagacagtgaccaagccatcagggaccggttctcccggctgcggtaccagagtgaggcgtagaggcacgccagccagagcctgtggagagactccgcctgctgacactaaacgtcctgggaagtgggcccttccctgggtctctgcactgactcccccactcctgaccctggtgatggtcgccactgggcagcagcagccttaccagtcctccatgatcacacccagggacctgcatgggtgaggggacaccctgggcctctctcccgcccagcatcctccctgagtccccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccgggacaggccgtcccccaccccatcctgtagaagtccattccccttttccctcctgtgctctgtcccccaaggagtcatggaactcagggtactgggcctcaacgggaacctgagacagctccagcttcgcagcccttcccggagctacagggggatcctctagcatggggggtgtgacttggttcctttgaccaggtcctgtgaggaagcctggagcaagggtctcccccagcaggatgggtggggcctgctctggagctgagcccgtggccgctcacaggtgtccttagtggtgttgcagctgtctactggctgcatgtgctgtgaatatcccaaggaactggctgtggaatgcgtgtttgggtcagtctgtgccctctcagtagacactggagctgctctgtccctgaagaggccccgtgccccaggcatggcaagcgcctgcctctccccttccggtgctcacacgcccacgccgtgccacccgatgcaggactcacctctgtgccttgctgctcctgaggcccaagggcagccatggtgctctgtactgctcgggccgcccaggtcacagagcctgagcttcgtagccaaagcagcctgatgacccacccaccaaggaagaaagcagaataaacatttttgcactgcctgaaaaaccccggtggtcaggcgtgagccta

SEQ ID NO: 2858 - DNA, 3213 bp, Homo sapiens
tcgggagaggaggaggaggggagcgaggacgcagagaaggaggggaaagaggacggagaggagcgaggacggaggggggacgggaacgaagaggggcgaggacgttcagcatccattgcgacagcgacaaacaggacaccgccaggttcccggcggaggcagcgcccaagatccccgttgccgagcaaccgaagcatggcggtggggcggggtcggagcctgcgcatttccgcccccgcccgcccggctggtcggaagtgacgccagggggcggggccagcggcgcggtcgggtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggtgcgggaccttgtcccaagcagcagggtggtccgcctgggtgagggtgggccagacagtgaccaagccatcagggaccggttctcccggctgcggtaccagagtgaggcgtagaggcacgccagccagagcctgtggagagactccgcctgctgacactaaacgtcctgggaagtgggcccttccctgggtctctgcactgactcccccactcctgaccctggtgatggtcgccactgggcagcagcagccttaccagtcctccatgatcacacccagggacctgcatgggtgaggggacaccctgggcctctctcccgcccagcatcctccctgagtccccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccgggacaggccgtcccccaccccatcctgtagaagtccattccccttttccctcctgtgctctgtcccccaaggagtcatggaactcagggtactgggcctcaacgggaacctgagacagctccagcttcgcagcccttcccggagctacagggggatcctctagcatggggggtgtgacttggttcctttgaccaggtcctgtgaggaagcctggagcaagggtctcccccagcaggatgggtggggcctgctctggagctgagcccgtggccgctcacaggtgtccttagtggtgttgcagctgtctactggctgcatgtgctgtgaatatcccaaggaactggctgtggaatgcgtgtttgggtcagtctgtgccctctcagtagacactggagctgctctgtccctgaagaggccccgtgccccaggcatggcaagcgcctgcctctccccttccggtgctcacacgcccacgccgtgccacccgatgcaggactcacctctgtgccttgctgctcctgaggcccaagggcagccatggtgctctgtactgctcgggccgcccaggtcacagagcctgagcttcgtagccaaagcagcctgatgacccacccaccaaggaagaaagcagaataaacatttttgcactgcctgaaaaaccccggtggtcaggcgtgagcctagcgtg

SEQ ID NO: 2859 - DNA, 583 bp, Homo sapiens
atttggggacaagcatttgggcacactcgctacaagattggttagtgattatggatgatgaagtctgtcggaaaattcagatcttgattgtccacctgggcttgcgaaggcacagattccccgtccacagctcacgaccagatgcaccagcaggagtccacatcgaggacgtcctccgggcactcccacgaccagataaggaaactgaggcacagttcagtcaaagcacatgtcctggtcacacagctagggaggtgcaagcctgcccgcccagagcccatcttcactccggctttgtgccgtgggactgctggcctcgccgacctcttgctttatcgacacagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgt

SEQ ID NO: 2860 - DNA, 583 bp, Homo sapiens
ggggccagcggcgcggtcgggtgagaggccgcggcggcaggtccacctgggcttgcgaaggcacagattccccgtccacagctcacgaccagatgcaccagcaggagtccacatcgaggacgtcctccgggcactcccacgaccagataaggaaactgaggcacagttcagtcaaagcacatgtcctggtcacacagctagggaggtgcaagcctgcccgcccagagcccatcttcactccggtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacgggg

SEQ ID NO: 2861 - DNA, 1006 bp, Homo sapiens
ggccgcggcggcagagatggtccgtgcatgggggaaatgtttgtcctttcggccaggctctccaattcaaaaggcaggaattgagaaaatgacagtactttctctgtccctgccacagaatgtccagtttggtctgatttaacatgacaaatcatgctgtagagataagtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggag

SEQ ID NO: 2862 - DNA, 374 bp, Homo sapiens
ggcgcggtcgggtgagaggccgcggcggcaggtccacctgggcttgcgaaggcacagattccccgtccacagctcacgaccagatgcaccagcaggagtccacatcgaggacgtcctccgggcactcccacgaccagctttgtgccgtgggactgctggcctcgccgacctcttgctttatcgacacagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggc

SEQ ID NO: 2863 - DNA, 2263 bp, Homo sapiens
cgggtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacggctcacactgggcgacagcggagaggctcttggacggggcagagctcgcgccgagacctgcatgtccgcgtcttgtgacgggtgtgtgggaagccgcccgcctgtgcatcttgcttccgggtattcgctggctgatttactggttttagagatggggatgggcacccagtgctggactgaagaccagagaaggtggagctccctgtggccttggtctcacctctcttcagcgggatcccagcctctgccaggagggccttgtacatgtcagacttcaggaaccttgggtaggagtcctacaagagacagcgtccagcccctgacccttctgcctcctcacctctcagccagctccacccgaaggagcagccaaacattgctggagcctcctccagccacagagtctccggcggacagggtgctggaggcagccgcctcggacctgcccagaccaaggcagacgcagggagacctgggctcccgtctgcctgggccatgtcgcagcaaaaaatggcaagagccctggtggccacgtgtagaggaataaaccgcggcacctcctcagccattagcgggaaccaggaatggctccgtgtgccccacagagtgagggcagggttgtggagtcaaataaaaaaacaaggtaggccacgc

SEQ ID NO: 2864 - DNA, 432 bp, Homo sapiens
gcggtcgggtgagaggccgcggcggcaggtccacctgggcttgcgaaggcacagattccccgtccacagctcacgaccagatgcaccagcaggagtccacatcgaggacgtcctccgggcactcccacgaccaggtagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagt

SEQ ID NO: 2865 - DNA, 1767 bp, Homo sapiens
ccgcggcggcaggtccacctgggcttgcgaaggcacagattccccgtccacagctcacgaccagatgcaccagcaggagtccacatcgaggacgtcctccgggcactcccacgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggctcacactgggcgacagcggagaggctcttggacggggcagagctcgcgccgagacctgcatgtccgcgtcttgtga

SEQ ID NO: 2866 - DNA, 984 bp, Homo sapiens
tcgggtgagaggccgcggcggcagcagaggtggggtttcaccatgttgttcaggctggtctcgaactcctgacttcgtgatctgcctgcctcggcctccgaaagtgctgggattacaggcgcaaaccaccacgcccggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggag

SEQ ID NO: 2867 - DNA, 5269 bp, Homo sapiens
gttttccttggtctggggctccccacagttccccaccatcactcctcccattccttccaactttatttttagctgccattgggagggggcaggatgggagggaaagtgaagaaaacagaaaaggagagggacagaggccagaggacttctcatactggacagaaaccgatcaggcatggaactccccttcgtcactcacctgttcttgcccctggtgttcctgacaggtctctgctccccctttaacctggatgaacatcacccacgcctattcccagggccaccagaagctgaatttggatacagtgtcttacaacatgttgggggtggacagcgatggatgctggtgggcgccccctgggatgggccttcaggcgaccggaggggggacgtttatcgctgccctgtagggggggcccacaatgccccatgtgccaagggccacttaggtgactaccaactgggaaattcatctcatcctgctgtgaatatgcacctggggatgtctctgttagagacagatggtgatgggggattcatggcctgtgcccctctctggtctcgtgcttgtggcagctctgtcttcagttctgggatatgtgcccgtgtggatgcttcattccagcctcagggaagcctggcacccactgcccaacgctgcccaacatacatggatgttgtcattgtcttggatggctccaacagcatctacccctggtctgaagttcagaccttcctacgaagactggtagggaaactgtttattgacccagaacagatacaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctgcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtccttggtcactacctccggcggcagcgagatcccagctctttcctgagagaaattagaactattgccagtgatccagatgagcgattctttttcaatgtcacagatgaggctgctctgactgacattgtggatgcactaggagatcggatttttggccttgaagggtcccatgcagaaaacgaaagctcctttgggctggaaatgtctcagattggtttctccactcatcggctaaaggatgggattctttttgggatggtgggggcctatgactggggaggctctgtgctatggcttgaaggaggccaccgccttttccccccacgaatggcactggaagacgagttcccccctgcattgcagaaccatgcagcctacctgggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcagattggttcatactttggcagtgagctctgcccattggatacagatagggatggaacaactgatgtcttacttgtggctgcccccatgttcctgggaccccagaacaaggaaacaggacgtgtttatgtgtatctggtaggccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccagaggattgctgctgcctccatgccacatgccctcagctactttggccgaagtgtggatggtcggctagatctggatggagatgatctggtcgatgtggctgtgggtgcccagggggcagccatcctgctcagctcccggcccattgtccatctgaccccatcactggaggtgaccccacaggccatcagtgtggttcagagggactgtaggcggcgaggccaagaggcagtctgtctgactgcagccctttgcttccaagtgacctcccgtactcctggtcgctgggatcaccaattctacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggatacatcagattacctccggccagtggccttgactgtgacctttgccttggacaatactacaaagccagggcctgtgctgaatgagggctcacccacctctatacaaaagctggtccccttctcaaaggattgtggccctgacaatgaatgtgtcacagacctggtgcttcaagtgaatatggacatcagaggctccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcagagagagagcccaataaaggtggaatgtgccgccccttctgctcatgcccggctctgcagtgtggggcatcctgtcttccagactggagccaaggtgacctttctgctagagtttgagtttagctgctcctctctcctgagccaggtcttcgtgaagctgactgccagcagtgacagcctggagagaaatgggacccttcaagataacacagcccagacctcagcctacatccaatatgagccccacctcctgttctctagtgagtctaccctgcaccgctatgaggttcacccatatgggaccctcccagtgggtcctggcccagaattcaaaaccactctcagggttcagaacctaggctgctatgtggtcagtggcctcatcatctcagccctccttccagctgtggcccatgggggcaattacttcctatcactgtctcaagtcatcactaacaatgcaagctgcatagtgcagaacctgactgaacccccaggcccacctgtgcatccagaggagcttcaacacacaaacagactgaatgggagcaatactcagtgtcaggtggtgaggtgccaccttgggcagctggcaaaggggactgaggtctctgttggactattgaggctggttcacaatgaatttttccgaagagccaagttcaagtccctgacggtggtcagcacctttgagctgggaaccgaagagggcagtgtcctacagctgactgaagcctcccgttggagtgagagcctcttggaggtggttcagacccggcctatcctcatctccctgtggatcctcataggcagtgtcctgggagggttgctcctgcttgctctccttgtcttctgcctgtggaagcttggcttctttgcccataagaaaatccctgaggaagaaaaaagagaagagaagttggagcaatgaatgtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaatcaataatttttttgcctaggtgcctgactcctttcagattccctctttatcttccctcacagtttggaaaggatgagggttatcttcctcgattcttccaccctctcactttcctgcctgttccccactccacaggagggagctgacgttggcttgaaaggagtaaagtcaacatctgctgctttcctgtggactctggtgattcatagagccggatggggagagtcaacaggaaaaaaggagggaggaggaaaagccacaagagacattctgtacaattccaaggaacagagaagcctttagacaggcaactgccatcccccctgaaacctgagacctgtagtgcactcgaccgccctcaggtgttggtgaaacagagctgcccccaggctcgctgggcataggcttcctgattccaagccttttctgggagcaaagccagggcctggtgcctgattttctgaagccaggagccctcaggtggctggagctggaatagcagggaggactgggtgtacctaggcagtattttctctacttctctcaagtcttatactcactcttgagccctccttggggcctgcttagaaagcagacaggagagagagtactgctacttgatgatgggaaatgctttcactttaccagctttgggaagcagcagccccatgggatctaaaagtgtggagtctgcattaagaaacctacatgggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaacccactccatatttgggtcatggacagtaaaggcagttggattctcatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcagatggtcagaacaaataaagttcagtgtcaaatga

SEQ ID NO: 2868 - DNA, 3479 bp, Homo sapiens
acttctcatactggacagaaaccgatcaggcatggaactccccttcgtcactcacctgttcttgcccctggtgttcctgacaggtctctgctccccctttaacctggatgaacatcacccacgcctattcccagggccaccagaagctgaatttggatacagtgtcttacaacatgttgggggtggacagcgatggctgcccaacatacatggatgttgtcattgtcttggatggctccaacagcatctacccctggtctgaagttcagaccttcctacgaagactggtagggaaactgtttattgacccagaacagatacaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctgcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtccttggtcactacctccggcggcagcgagatcccagctctttcctgagagaaattagaactattgccagtgatccagatgagcgattctttttcaatgtcacagatgaggctgctctgactgacattgtggatgcactaggagatcggatttttggccttgaagggtcccatgcagaaaacgaaagctcctttgggctggaaatgtctcagattggtttctccactcatcggctaaaggatgggattctttttgggatggtgggggcctatgactggggaggctctgtgctatggcttgaaggaggccaccgccttttccccccacgaatggcactggaagacgagttcccccctgcattgcagaaccatgcagcctacctgggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcagattggttcatactttggcagtgagctctgcccattggatacagatagggatggaacaactgatgtcttacttgtggctgcccccatgttcctgggaccccagaacaaggaaacaggacgtgtttatgtgtatctggtaggccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccagaggattgctgctgcctccatgccacatgccctcagctactttggccgaagtgtggatggtcggctagatctggatggagatgatctggtcgatgtggctgtgggtgcccagggggcagccatcctgctcagctcccggcccattgtccatctgaccccatcactggaggtgaccccacaggccatcagtgtggttcagagggactgtaggcggcgaggccaagaggcagtctgtctgactgcagccctttgcttccaagtgacctcccgtactcctggtcgctgggatcaccaattctacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggatacatcagattacctccggccagtggccttgactgtgacctttgccttggacaatactacaaagccagggcctgtgctgaatgagggctcacccacctctatacaaaagctggtccccttctcaaaggattgtggccctgacaatgaatgtgtcacagacctggtgcttcaagtgaatatggacatcagaggctccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcagagagagagcccaataaaggtggaatgtgccgccccttctgctcatgcccggctctgcagtgtggggcatcctgtcttccagactggagccaaggtgacctttctgctagagtttgagtttagctgctcctctctcctgagccaggtcttcgtgaagctgactgccagcagtgacagcctggagagaaatgggacccttcaagataacacagcccagacctcagcctacatccaatatgagccccacctcctgttctctagtgagtctaccctgcaccgctatgaggttcacccatatgggaccctcccagtgggtcctggcccagaattcaaaaccactctcagggttcagaacctaggctgctatgtggtcagtggcctcatcatctcagccctccttccagctgtggcccatgggggcaattacttcctatcactgtctcaagtcatcactaacaatgcaagctgcatagtgcagaacctgactgaacccccaggcccacctgtgcatccagaggagcttcaacacacaaacagactgaatgggagcaatactcagtgtcaggtggtgaggtgccaccttgggcagctggcaaaggggactgaggtctctgttggactattgaggctggttcacaatgaatttttccgaagagccaagttcaagtccctgacggtggtcagcacctttgagctgggaaccgaagagggcagtgtcctacagctgactgaagcctcccgttggagtgagagcctcttggaggtggttcagacccggcctatcctcatctccctgtggatcctcataggcagtgtcctgggagggttgctcctgcttgctctccttgtcttctgcctgtggaagcttggcttctttgcccataagaaaatccctgaggaagaaaaaagagaagagaagttggagcaatgaatgtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagcc

SEQ ID NO: 2869 - DNA, 3380 bp, Homo sapiens
gagggacagaggccagaggacttctcatactggacagaaaccgatcaggcatggaactccccttcgtcactcacctgttcttgcccctggtgttcctgacaggctgcccaacatacatggatgttgtcattgtcttggatggctccaacagcatctacccctggtctgaagttcagaccttcctacgaagactggtagggaaactgtttattgacccagaacagatacaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctgcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtccttggtcactacctccggcggcagcgagatcccagctctttcctgagagaaattagaactattgccagtgatccagatgagcgattctttttcaatgtcacagatgaggctgctctgactgacattgtggatgcactaggagatcggatttttggccttgaagggtcccatgcagaaaacgaaagctcctttgggctggaaatgtctcagattggtttctccactcatcggctaaaggatgggattctttttgggatggtgggggcctatgactggggaggctctgtgctatggcttgaaggaggccaccgccttttccccccacgaatggcactggaagacgagttcccccctgcattgcagaaccatgcagcctacctgggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcagattggttcatactttggcagtgagctctgcccattggatacagatagggatggaacaactgatgtcttacttgtggctgcccccatgttcctgggaccccagaacaaggaaacaggacgtgtttatgtgtatctggtaggccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccagaggattgctgctgcctccatgccacatgccctcagctactttggccgaagtgtggatggtcggctagatctggatggagatgatctggtcgatgtggctgtgggtgcccagggggcagccatcctgctcagctcccggcccattgtccatctgaccccatcactggaggtgaccccacaggccatcagtgtggttcagagggactgtaggcggcgaggccaagaggcagtctgtctgactgcagccctttgcttccaagtgacctcccgtactcctggtcgctgggatcaccaattctacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggatacatcagattacctccggccagtggccttgactgtgacctttgccttggacaatactacaaagccagggcctgtgctgaatgagggctcacccacctctatacaaaagctggtccccttctcaaaggattgtggccctgacaatgaatgtgtcacagacctggtgcttcaagtgaatatggacatcagaggctccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcagagagagagcccaataaaggtggaatgtgccgccccttctgctcatgcccggctctgcagtgtggggcatcctgtcttccagactggagccaaggtgacctttctgctagagtttgagtttagctgctcctctctcctgagccaggtcttcgtgaagctgactgccagcagtgacagcctggagagaaatgggacccttcaagataacacagcccagacctcagcctacatccaatatgagccccacctcctgttctctagtgagtctaccctgcaccgctatgaggttcacccatatgggaccctcccagtgggtcctggcccagaattcaaaaccactctcagggttcagaacctaggctgctatgtggtcagtggcctcatcatctcagccctccttccagctgtggcccatgggggcaattacttcctatcactgtctcaagtcatcactaacaatgcaagctgcatagtgcagaacctgactgaacccccaggcccacctgtgcatccagaggagcttcaacacacaaacagactgaatgggagcaatactcagtgtcaggtggtgaggtgccaccttgggcagctggcaaaggggactgaggtctctgttggactattgaggctggttcacaatgaatttttccgaagagccaagttcaagtccctgacggtggtcagcacctttgagctgggaaccgaagagggcagtgtcctacagctgactgaagcctcccgttggagtgagagcctcttggaggtggttcagacccggcctatcctcatctccctgtggatcctcataggcagtgtcctgggagggttgctcctgcttgctctccttgtcttctgcctgtggaagcttggcttctttgcccataagaaaatccctgaggaagaaaaaagagaagagaagttggagcaatgaatgtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttcc

SEQ ID NO: 2870 - DNA, 5029 bp, Homo sapiens
gggaaagtgaagaaaacagaaaaggagagggacagaggccagaggacttctcatactggacagaaaccgatcaggcatggaactccccttcgtcactcacctgttcttgcccctggtgttcctgacaggtctctgctccccctttaacctggatgaacatcacccacgcctattcccagggccaccagaagctgaatttggatacagtgtcttacaacatgttgggggtggacagcgatggatgctggtgggcgccccctgggatgggccttcaggcgaccggagggggggcccacaatgccccatgtgccaagggccacttaggtgactaccaactgggaaattcatctcatcctgctgtgaatatgcacctggggatgtctctgttagagacagatggtgatgggggattcatggcctgtgcccctctctggtctcgtgcttgtggcagctctgtcttcagttctgggatatgtgcccgtgtggatgcttcattccagcctcagggaagcctggcacccactgcccaacgctgcccaacatacatggatgttgtcattgtcttggatggctccaacagcatctacccctggtctgaagttcagaccttcctacgaagactggtagggaaactgtttattgacccagaacagatacaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctgcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtccttggtcactacctccggcggcagcgagatcccagctctttcctgagagaaattagaactattgccagtgatccagatgagcgattctttttcaatgtcacagatgaggctgctctgactgacattgtggatgcactaggagatcggatttttggccttgaagggtcccatgcagaaaacgaaagctcctttgggctggaaatgtctcagattggtttctccactcatcggctaaaggatgggattctttttgggatggtgggggcctatgactggggaggctctgtgctatggcttgaaggaggccaccgccttttccccccacgaatggcactggaagacgagttcccccctgcattgcagaaccatgcagcctacctgggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcagattggttcatactttggcagtgagctctgcccattggatacagatagggatggaacaactgatgtcttacttgtggctgcccccatgttcctgggaccccagaacaaggaaacaggacgtgtttatgtgtatctggtaggccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccagaggattgctgctgcctccatgccacatgccctcagctactttggccgaagtgtggatggtcggctagatctggatggagatgatctggtcgatgtggctgtgggtgcccagggggcagccatcctgctcagctcccggcccattgtccatctgaccccatcactggaggtgaccccacaggccatcagtgtggttcagagggactgtaggcggcgaggccaagaggcagtctgtctgactgcagccctttgcttccaagtgacctcccgtactcctggtcgctgggatcaccaattctacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggatacatcagattacctccggccagtggccttgactgtgacctttgccttggacaatactacaaagccagggcctgtgctgaatgagggctcacccacctctatacaaaagctggtccccttctcaaaggattgtggccctgacaatgaatgtgtcacagacctggtgcttcaagtgaatatggacatcagaggctccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcagagagagagcccaataaaggtggaatgtgccgccccttctgctcatgcccggctctgcagtgtggggcatcctgtcttccagactggagccaaggtgacctttctgctagagtttgagtttagctgctcctctctcctgagccaggtcttcgtgaagctgactgccagcagtgacagcctggagagaaatgggacccttcaagataacacagcccagacctcagcctacatccaatatgagccccacctcctgttctctagtgagtctaccctgcaccgctatgaggttcacccatatgggaccctcccagtgggtcctggcccagaattcaaaaccactctcagggttcagaacctaggctgctatgtggtcagtggcctcatcatctcagccctccttccagctgtggcccatgggggcaattacttcctatcactgtctcaagtcatcactaacaatgcaagctgcatagtgcagaacctgactgaacccccaggcccacctgtgcatccagaggagcttcaacacacaaacagactggccaagttcaagtccctgacggtggtcagcacctttgagctgggaaccgaagagggcagtgtcctacagctgactgaagcctcccgttggagtgagagcctcttggaggtggttcagacccggcctatcctcatctccctgtggatcctcataggcagtgtcctgggagggttgctcctgcttgctctccttgtcttctgcctgtggaagcttggcttctttgcccataagaaaatccctgaggaagaaaaaagagaagagaagttggagcaatgaatgtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaatcaataatttttttgcctaggtgcctgactcctttcagattccctctttatcttccctcacagtttggaaaggatgagggttatcttcctcgattcttccaccctctcactttcctgcctgttccccactccacaggagggagctgacgttggcttgaaaggagtaaagtcaacatctgctgctttcctgtggactctggtgattcatagagccggatggggagagtcaacaggaaaaaaggagggaggaggaaaagccacaagagacattctgtacaattccaaggaacagagaagcctttagacaggcaactgccatcccccctgaaacctgagacctgtagtgcactcgaccgccctcaggtgttggtgaaacagagctgcccccaggctcgctgggcataggcttcctgattccaagccttttctgggagcaaagccagggcctggtgcctgattttctgaagccaggagccctcaggtggctggagctggaatagcagggaggactgggtgtacctaggcagtattttctctacttctctcaagtcttatactcactcttgagccctccttggggcctgcttagaaagcagacaggagagagagtactgctacttgatgatgggaaatgctttcactttaccagctttgggaagcagcagccccatgggatctaaaagtgtggagtctgcattaagaaacctacatgggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaacccactccatatttgggtcatggacagtaaaggcagttggattctcatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcagatggtcagaacaaataaagttcagtgtcaaatg

SEQ ID NO: 2871 - DNA, 6755 bp, Homo sapiens
gagatgggactgcaatagaaatccgggcagcccgaagaggcacccagcgctccagccaccagctgggccgcccgggagtccctggctctagaccagccgcgaggaggcgccgcgagagagctggtccctgcccgcggccggaggagggctagagcccctgggccagccccccgagccggctgggcgggcgggcgggtgggagcagacgccgggcactgtcaccacgggtgcgccgagcgcaccgacccgggacacgggcagctggggaccgccagattccaccagccccccttgccccgcaggggtcctcggctcgcgctcctgggtagcagccacccaccggggcggagggagatgtcgcccggggccagccgcggtccccggggaagccaggcgccgctgatcgcgcccctctgctgcgccgcggccgcgctggggatgttgctgtggtcccccgcctgtcaggcgttcaacctggacgtggaaaagctcacagtgtacagcggccccaagggcagctacttcggctacgccgtggacttccacatacccgacgcccgcacagcgagtgtcttggtgggggcgcccaaagccaacaccagccagcccgatatcgtggaagggggagccgtctattactgtccttggcccgcggaggggtctgcgcagtgcaggcagataccgtttgacaccaccaacaacagaaagatcagagttaatggaaccaaagaacctatcgagttcaaatccaatcagtggtttggagcaacagtgaaagctcacaaaggaaaagttgtggcctgtgctcctttatatcactggagaactcttaaaccgacaccagaaaaggacccagttggcacctgctatgtagcaattcagaacttcagcgcctatgccgagttctctccttgccggaacagcaatgctgatccggaaggccagggttactgccaagcaggatttagtctggatttttataagaatggagaccttattgtgggaggacctgggagtttctactggcaaggacaagtgatcactgccagtgttgcagatatcattgcaaattactcattcaaggatatcctcaggaaactggcaggagaaaagcagacggaagtggctccagcttcctatgatgacagttaccttggatactcagttgctgctggggagtttactggggattctcagcaagaattggttgctggaattccaagaggagcacagaattttggatatgtttccatcattaactctacggatatgacgtttattcagaatttcacgggagaacagatggcatcttattttggatataccgttgtcgtatcagatgttaacagtgatggactggatgatgtcctggttggggcacctctctttatggaacgtgaatttgagagcaaccccagagaagtagggcaaatctacctgtatttgcaagtgagctctctcctcttcagagacccccagatcctcactggcaccgagacgtttgggagattcggtagtgctatggcacacttaggagacctgaaccaagatggatacaatgacattgccatcggagtgccttttgcaggcaaggatcaaagaggcaaagtgctcatttataatgggaacaaagatggcttaaacaccaagccttcccaagttctgcaaggagtgtgggcctcacatgctgtcccttccggatttggctttactttaagaggagattcagacatagacaagaatgattacccagatttgattgtgggtgcatttggaacaggaaaagtcgctgtttacagagcaagaccggttgtgactgtagatgcccagcttctgctgcacccaatgattatcaatcttgaaaataaaacttgccaggttccagactctatgacatctgctgcctgcttttctttaagagtatgtgcatctgtcacaggccagagcattgcaaacacaatagtcttgatggcagaggtgcaattagattccctgaaacagaaaggagctattaaacggacgctcttccttgataaccatcaggctcatcgcgtcttccctcttgtgataaaaaggcagaaatcccaccagtgccaggatttcatcgtttaccttcgagatgaaactgaattccgagataaattatctccaatcaacattagtttgaattacagtttggacgaatccacctttaaagaaggcctggaagtgaaaccaatattgaactactacagagaaaacattgttagtgaacaggctcacattctggtggactgtggagaagacaatctgtgtgttcctgacttgaagctgtcggctagaccagataagcatcaggtaatcattggagatgaaaatcaccttatgctcataataaatgcaagaaatgaaggggaaggagcatatgaagctgaactctttgtaatgataccagaagaggcagattatgttggaatcgaacgcaacaacaagggatttcgaccactgagctgtgagtacaagatggaaaatgtaaccaggatggtggtgtgtgaccttgggaaccctatggtgtctggaacaaattattccctgggcctccgatttgcagttccacgtcttgagaaaacaaacatgagcattaacttcgatctccaaatcagaagttccaacaaggacaatccagacagcaattttgtgagcctgcaaatcaacatcactgctgtagcgcaggtggaaataagaggagtgtcacaccctccgcagattgttctgcccattcataactgggaaccagaagaggagccccacaaagaggaggaggttggaccattggtggaacatatttatgagctgcacaatattggaccaagtaccatcagtgacaccatcctggaggtgggctggcctttctctgcccgggatgaatttcttctctatattttccatattcaaactctgggacctctgcagtgccaaccaaatcctaatatcaatccacaggatataaagcctgctgcctccccagaggacacccctgagctcagcgcctttttgcgaaactctactattcctcatcttgtcaggaagagggatgtacatgtggtcgaattccacagacagagccctgcaaaaatactgaattgtacaaatatcgagtgtttacaaatctcctgtgcagtgggacgactcgaaggaggagaaagcgcagtcctgaaagtcaggtcacgattatgggcccacaccttcctccagagaaaaaatgatccctatgctcttgcatccctggtgtcctttgaagttaagaagatgccttatacagatcagccagcaaaactcccagaaggaagcatagtaattaagacatcagttatttgggcaactccgaatgtttccttctcaatcccattatgggtaataatactagcaatacttcttggattgttggttctcgccattttaaccttagctttatggaagtgtggattctttgacagagccagacctcctcaggaggacatgaccgacagggaacagctgacaaatgacaagacccctgaggcatgacaagaaaaaaaaagaagaccaaagacctcaaacactggtcctgttcaaagaaaaagaaagaacatgagggttaaaaatcaaagctttctgatacctgacagtgacccaggaaatggaggggaccctggaaacatcacctcatctacaccgcactttggagaaattgtcctgggtgcccagtgagccctgttggaaaaggaaacaccaaagctggagaagccatcagcaattgtggaagattttcttttgctttaatcgttctgtacttggcagacactttgaaatgcgtatgggaacgtaagttgcagtccagatcaatccagcataagttgcagagatgaaatgtctgaatcactatagaatttacaaggtgaactaaggtgaaatgactgatttactatagaacttagaactaagaccacaccatccaacactactgtatccaatggaacatttgacacctccctatggaaaagaaacatttctaaggacattatggctcagggagacaagcaatatgttgttggtactgtgaaagtacttttgaaaggacaaaaataatcttgtgagtgagggtgagagtttatttatttattttccatgtctctaggttgagaatctgtcatctagagaatttggaaattaagatttggttagctagttttcaaaatcactcactcagtttcctcctaagaaccactgtgtgcagataactcatttagcagagcttcttcagaatttagacagtgctaaggaaaggaagattggcattaggaatcagttctatttaataccttgctgccttccatctgaaattcctttcactcacattatccagggactcacatctgcttaatttagctttgcaagatgttgcatttatatttccttgtatatctttccattgacttagttaatacatgaatttcgaggtactctctacctttggagtgtttaaaagtcatggtaaaatgtctagagttcattaattaaaaagcaatttaacattatgggtaaacattatttttaatatctataagaagcaacacttcttatagatatttagcttgggattaaatacccgtttttcctgctatgccttgtacttgtatacacagagaaaacatgttgaatataacttagacaaaaacataaaattatacaggcatgagccaaactgggaaaactgattcctaaagatttttatttaaaattgcttattccaactttattacttatttttactgctaatctttataatatgtaactttggagaataatcttttatttaagctattttcccatcatcttgaatttaaccatcacaaattttttatgtttaaaactcttgtaaataattcataatcttgtaatattatcatttttgaagtaaaattgaccagccaaatttataggtagtctgcacaattttgtatccttttttaataatgaaaaattactatgaagaaatactgaacaaatttttatgtgcaatattttatagacctatgtatctgaagcatgtttacactggcgtttttttttttaattaatttcctaaatgttaagtatgatagaacaagctgacccaaatccttaagtttacaaagctgttggaaaactttgtgtcctgatttcaacaatcacgctttgtttgaaagatgagccaagctcacagacactaaattttatgtcatgccataagctggagaggagccatttggctacagctgcggaacttcattgaggagcaaatgaaaggcacatggacgagcacgctggtgcagttcatgttcttcctgcctgtgaattgaatactgtcctggtagcagtttcgggtcggtcaggagctcaaggctggtttgtgtggctgactacggatgagcactgaagttgcctcaaagaattaaggggtgtccacaccagcctctgggggtctttggtgttagtcttccaggtagagctggttttacaagtaggtggccatctacaggatgtgatgtgagcgatgccagacagctctctctgaccccaggtaatgccctgaatctggtgatcctggctgatctgtgaccaatagagattagctccttgggatttggggtcctaaaaggtccctgaaaaaatgcaccccttgtctttaagccaacattggtgaaggaactgagaactcttagggttacataaaaaaagacccctgttgagatagtttatgcagatacctggaaggaactagagatgccaggaggaagactgagacccagaatgaagcaaggcatgagggctccaaagtgaactgcaccatcccagagtctcagccaagatggccctttcctagagggacgggcaccttccacctgcccacaggcactgctacctatgggaattgcagaaggccgttgtacacacgcgcatgcacgcagtggccctctgccctttagaatatggaagcaaagtctgggtgcagtgactcacacttgtaatcccaacactttgggaggccgagacgggcagatcacctgagttcaggagttcaagaccagcctggccaacgtggcaaaaccccatctctactaaaaatacaaaaattagctgggcgtggtggcagtctcctgtaatcccagctacctaggaggctgaggcagagagagaatcgcttgaacccaggaggcggaggttgcagtgagctgagatcgcgcgactgcactccagcctgggcgacagagggaaactctgtctcaacaaaaaaataaataaaataaaaaataaaaaaagaatatggaagcaaatggagaaagggaggaaactgaggtcaggcaaaccttccagcaatccgttctgcccagagaacatactgacgacagagaacacactgagcgttatctgcttctagttagagcattgccgattgccttcataattcataatgtgctgtgctcctctgagggtctatctgtatttctcttcaaagaattccctttttaaattcttgcagctgggttttaagacacaataatggggcaaattaagttttataaacttggagatttttatacagtaaataaaaaaataatatgtactagtcacccctgaaactgcattcttagaactcgactcttgttttatttaaatacgtgcgtagatatctgtgaagattttcatgtacctatttaccttgtcactaataaaattaaaactgaaagacttga

SEQ ID NO: 2872 - DNA, 3216 bp, Homo sapiens
atgtcgcccggggccagccgcggtccccggggaagccaggcgccgctgatcgcgcccctctgctgcgccgcggccgcgctggggatgttgctgtggtcccccgcctgtcaggcgttcaacctggacgtggaaaagctcacagtgtacagcggccccaagggcagctacttcggctacgccgtggacttccacatacccgacgcccgcacagcgagtgtcttggtgggggcgcccaaagccaacaccagccagcccgatatcgtggaagggggagccgtctattactgtccttggcccgcggaggggtctgcgcagtgcaggcagataccgtttgacaccaccaacaacagaaagatcagagttaatggaaccaaagaacctatcgagttcaaatccaatcagtggtttggagcaacagtgaaagctcacaaaggaaaagttgtggcctgtgctcctttatatcactggagaactcttaaaccgacaccagaaaaggacccagttggcacctgctatgtagcaattcagaacttcagcgcctatgccgagttctctccttgccggaacagcaatgctgatccggaaggccagggttactgccaagcaggatttagtctggatttttataagaatggagaccttattgtgggaggacctgggagtttctactggcaaggacaagtgatcactgccagtgttgcagatatcattgcaaattactcattcaaggatatcctcaggaaactggcaggagaaaagcagacggaagtggctccagcttcctatgatgacagttaccttgaattggttgctggaattccaagaggagcacagaattttggatatgtttccatcattaactctacggatatgacgtttattcagaatttcacgggagaacagatggcatcttattttggatataccgttgtcgtatcagatgttaacagtgatggactggatgatgtcctggttggggcacctctctttatggaacgtgaatttgagagcaaccccagagaagtagggcaaatctacctgtatttgcaagtgagctctctcctcttcagagacccccagatcctcactggcaccgagacgtttgggagattcggtagtgctatggcacacttaggagacctgaaccaagatggatacaatgacattgccatcggagtgccttttgcaggcaaggatcaaagaggcaaagtgctcatttataatgggaacaaagatggcttaaacaccaagccttcccaagttctgcaaggagtgtgggcctcacatgctgtcccttccggatttggctttactttaagaggagattcagacatagacaagaatgattacccagatttgattgtgggtgcatttggaacaggaaaagtcgctgtttacagagcaagaccggttgtgactgtagatgcccagcttctgctgcacccaatgattatcaatcttgaaaataaaacttgccaggttccagactctatgacatctgctgcctgcttttctttaagagtatgtgcatctgtcacaggccagagcattgcaaacacaatagtcttgatggcagaggtgcaattagattccctgaaacagaaaggagctattaaacggacgctcttccttgataaccatcaggctcatcgcgtcttccctcttgtgataaaaaggcagaaatcccaccagtgccaggatttcatcgtttaccttcgagatgaaactgaattccgagataaattatctccaatcaacattagtttgaattacagtttggacgaatccacctttaaagaaggcctggaagtgaaaccaatattgaactactacagagaaaacattgttagtgaacaggctcacattctggtggactgtggagaagacaatctgtgtgttcctgacttgaagctgtcggctagaccagataagcatcaggtaatcattggagatgaaaatcaccttatgctcataataaatgcaagaaatgaaggggaaggagcatatgaagctgaactctttgtaatgataccagaagaggcagattatgttggaatcgaacgcaacaacaagggatttcgaccactgagctgtgagtacaagatggaaaatgtaaccaggatggtggtgtgtgaccttgggaaccctatggtgtctggaacaaattattccctgggcctccgatttgcagttccacgtcttgagaaaacaaacatgagcattaacttcgatctccaaatcagaagttccaacaaggacaatccagacagcaattttgtgagcctgcaaatcaacatcactgctgtagcgcaggtggaaataagaggagtgtcacaccctccgcagattgttctgcccattcataactgggaaccagaagaggagccccacaaagaggaggaggttggaccattggtggaacatatttatgagctgcacaatattggaccaagtaccatcagtgacaccatcctggaggtgggctggcctttctctgcccgggatgaatttcttctctatattttccatattcaaactctgggacctctgcagtgccaaccaaatcctaatatcaatccacaggatataaagcctgctgcctccccagaggacacccctgagctcagcgcctttttgcgaaactctactattcctcatcttgtcaggaagagggatgtacatgtggtcgaattccacagacagagccctgcaaaaatactgaattgtacaaatatcgagtgtttacaaatctcctgtgcagtgggacgactcgaaggaggagaaagcgcagtcctgaaagtcaggtcacgattatgggcccacaccttcctccagagaaaaaatgatccctatgctcttgcatccctggtgtcctttgaagttaagaagatgccttatacagatcagccagcaaaactcccagaaggaagcatagtaattaagacatcagttatttgggcaactccgaatgtttccttctcaatcccattatgggtaataatactagcaatacttcttggattgttggttctcgccattttaaccttagctttatggaagtgtggattctttgacagagccagacctcctcaggaggacatgaccgacagggaacagctgacaaatgacaagacccctgaggcatgacaagaaaaaaaaagaagaccaaagacctcaaacactggtcctgttcaaagaaaaagaaagaacatgagg

SEQ ID NO: 2873 - DNA, 3860 bp, Homo sapiens
ccgcctcctggcctcctggctgaggggaagctgagtgggccacggcccatgtgtcgcactcgcctcggctcccacacagccgcctctgctccagcaaggatgtggctcttccacactctgctctgcatagccagcctggccctgctggccgctttcaatgtggatgtggcccggccctggctcacgcccaagggaggtgcccctttcgtgctcagctcccttctgcaccaagaccccagcaccaaccagacctggctcctggtcaccagccccagaaccaagaggacaccagggcccctccatcgatgttcccttgtccaggatgaaatcctttgccatcctgtagagcatgtccccatccccaaggggaggcaccggggagtgaccgttgtccggagccaccacggtgttttgatatgcattcaagtgctggtccggcggcctcacagcctcagctcagaactcacaggcacctgtagcctcctgggccctgacctccgtccccaggctcaggccaacttcttcgaccttgaaaatctcctggatccagatgcacgtgtggacactggagactgctacagcaacaaagaaggcggtggagaagacgatgtgaacacagccaggcagcgccgggctctggagaaggaggaggaggaagacaaggaggaggaggaagacgaggaggaggaggaagctggcaccgagattgccatcatcctggatggctcaggaagcattgatcccccagactttcagagagccaaagacttcatctccaacatgatgaggaacttctatgaaaagtgttttgagtgcaactttgccttggtgcagtatggaggagtgatccagactgagtttgaccttcgggacagccaggatgtgatggcctccctcgccagagtccagaacatcactcaagtggggagtgtcaccaagactgcctcagccatgcaacacgtcttagacagcatcttcacctcaagccacggctccaggagaaaggcatccaaggtcatggtggtgctcaccgatggtggcatattcgaggaccccctcaaccttacgacagtcatcaactcccccaaaatgcagggtgttgagcgctttgccattggggtgggagaagaatttaagagtgctaggactgcgagggaactgaacctgatcgcctcagacccggatgagacccatgctttcaaggtgaccaactacatggcgctggatgggctgctgagcaaactgcggtacaacatcatcagcatggaaggcacggttggagacgcccttcactaccagctggcacagattggcttcagtgctcagatcctggatgagcggcaggtgctgctcggcgccgtcggggcctttgactggtccggaggggcgttgctctacgacacacgcagccgccggggccgcttcctgaaccagacagcggcggcggcggcagacgcggaggctgcgcagtacagctacctgggttacgctgtggccgtgctgcacaagacctgcagcctctcctacatcgcgggggctccacggtacaaacatcatggggccgtgtttgagctccagaaggagggcagagaggccagcttcctgccagtgctggagggagagcagatggggtcctattttggctctgagctgtgccctgtggacattgacatggatggaagcacggacttcttgctggtggctgctccattttaccacgttcatggagaagaaggcagagtctacgtgtaccgtctcagcgagcaggatggttctttctccttggcacgcatactgagtgggcaccccgggttcaccaatgcccgctttggctttgccatggcggctatgggggatctcagtcaggataagctcacagatgtggccatcggggcccccctggaaggttttggggcagatgatggtgccagcttcggcagtgtgtatatctacaatggacactgggacggcctctccgccagcccctcgcagcggatcagagcctccacggtggccccaggactccagtacttcggcatgtccatggctggtggctttgatattagtggcgacggccttgccgacatcaccgtgggcactctgggccaggcggttgtgttccgctcccggcctgtggttcgcctgaaggtctccatggccttcacccccagcgcactgcccatcggcttcaacggcgtcgtgaatgtccgtttatgttttgaaatcagctctgtaaccacagcctctgagtcaggcctccgcgaggcacttctcaacttcacgctggatgtggatgtggggaagcagaggagacggctgcagtgttcagacgtaagaagctgtctgggctgcctgagggagtggagcagcggatcccagctttgtgaggacctcctgctcatgcccacagagggagagctctgtgaggaggactgcttctccaatgccagtgtcaaagtcagctaccagctccagacccctgagggacagacggaccatccccagcccatcctggaccgctacactgagccctttgccatcttccagctgccctatgagaaggcctgcaagaataagctgttttgtgtcgcagaattacagttggccaccaccgtctctcagcaggagttggtggtgggtctcacaaaggagctgaccctgaacattaacctaactaactccggggaagattcctacatgacaagcatggccttgaattaccccagaaacctgcagttgaagaggatgcaaaagcctccctctccaaacattcagtgtgatgaccctcagccggttgcttctgtcctgatcatgaactgcaggattggtcaccccgtcctcaagaggtcatctgctcatgtttcagtcgtttggcagctagaggagaatgcctttccaaacaggacagcagacatcactgtgactgtcaccaattccaatgaaagacggtctttggccaacgagacccacacccttcaattcaggcatggcttcgttgcagttctgtccaaaccatccataatgtacgtgaacacaggccaggggctttctcaccacaaagaattcctcttccatgtacatggggagaacctctttggagcagaataccagttgcaaatttgcgtcccaaccaaattacgaggtctccaggttgtagcagtgaagaagctgacgaggactcaggcctccacggtgtgcacctggagtcaggagcgcgcttgtgcgtacagttcggttcagcatgtggaagaatggcattcagtgagctgtgtcatcgcttcagataaagaaaatgtcaccgtggctgcagagatctcctgggatcactctgaggagttactaaaagatgtaactgaactgcagatccttggtgaaatatctttcaacaaatctctatatgagggactgaatgcagagaaccacagaactaagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacacttttctttgcagt

SEQ ID NO: 2874 - DNA, 4372 bp, Homo sapiens
gcggagccagcccctcccctacccggagcagcccgctggggccgtcccgagcggcgacacactaggagtcccggccggccagccagggcagccgcggtcccgggactcggccgtgagtgctgcgggacggatggtggcggcggggcgcgggccagcgcgggcgccgtgagccggagctgcgcgcggggcatgcggctgcggcccccggccctcggcccccgcgctccggccccagccccggccgccggcccccgcggagtgcagcgaccgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgatactctctgtgtgtttctttctttctgagcggacttaaaatggtgcccccagtggggattgaagcggccgtgtacttcctcagggatgggacacaggctggtctgatactccagactgcagcttgtcaagtaagcatgaggtgctcggggcagtgagggctgtgcaagggggaacactgagcagatacctttggccccttccagcttttactgacagagagttccaggctagacaccataaaaaccaccccttgttctgaggggctgaggctggaaatagattgtacagacaagcaagggttgagtggtggttcccacacgaagtcatctcttaatcatcattagcaatagcagttcccttccaaggcctcccctcactcccgaaacacttacgtcccatgcaggcccaatgcaaaaaaacacatttgagcttttttcccgcagggccatgaagtccccttaagttcccatatctaagatggttgactgaccctctccccttatgtacagaagaggaaactgattctcagagaggggaagtggcttgcccgagtgtttgttaggaggttactgaatgacaaactgttcctaagaccccatctcatgctggccagagggccagcctcctcattcctgcttgctcttagaaaatctttcactgatcattttttgtcactggaataacttcaaggttattatgctttcattccaaatggatctgtcctcagctctggacccaattccccttacttcattttggcaaacactaagtcaaatagtgaaatgcctgtcactacatagaacctattacctggggcaaatacgaacagattgagtttccttcatcttgtgtaaatatgatgaaacagagacctggtaacttggtgacactgttaaaccctttttgggataaagccaaatgtaaatgaaaacattaaacagataaattgtggtgttgagacttttctgaattgagaaaaataaatgtaattttggaagaaa

SEQ ID NO: 2875 - DNA, 3793 bp, Homo sapiens
cccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtgcttctcgcggagaccgcgggacccgccgtgccgagccgggagggccgcaggggccctgagatgccgagcggtgcccgggcccgcttacctgcaccgcttgctccgagccgcggggtccgcctgctaggcctgcggaaaacgtcctagcgacactcggcccgcgggccccgaggtgcgcccgggaggcgcgagcccgcgtccggaaggcagtcaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtgaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttcccagagagaacaatgctgtgagagagtttagcattgtgtcactacaagggtacagtaatccctgcactggacatgtgaggaaaaaaataatctggcaagtatattctaaggttgccaaacacttcaacagttggtggttgaatagacaagaacagctagatgaataaatgattcgtgtttcactctttcaagaggtgaacagatacaaccttaatcttaaaagattattgctttttaaagtgtgtagttttatgcatgtgtgtttatggtttgcttatttttgcaagatggatactaattccagcattctctcctctttgcctttatgttttgttttcttttttacaggataagtttatgtatgtcacagatgactggattaattaagtgctaagttactactgccataaaaaactaataatacaatgtcactttatcagaatactagttttaaaagctgaatgttaa

SEQ ID NO: 2876 - DNA, 3420 bp, Homo sapiens
ctgcccgggctgcagccgcgcctgcgggcagccgaggcgaggcgctccggtagcgtggggaggtttcctagcaactctctgccctgagtgcacccggctacccgcaggtctggagccccccggggggccagagcaggaccacccctctcccgcccatcgccggcctcgcctctctcgcatcctagccgtgtgcaccccagagcgcgccagcaactcgggctctggactgcgggacgcctgagccgcgcactgaggcgaaaaggacaagggcacgcagcccccgccccgcgaagccgggctccggcacctcgcggaacctcccctcctgcgctcgcagccgcaggccccactccccgccagggagggagcggcgatgcctcgctctgtgcctgcgggtgtcggcgggtgcttctagggcgctcccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtcttgggctggcacgaagagctgcccggccagagcatcccggccagaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttccc

SEQ ID NO: 2877 - DNA, 6689 bp, Homo sapiens
tttaagtagaatcctcaagcttggcctcagagtactatgaggcttctgaatccaggaataagactgctcttggatttactctctttgtattgcatgtcaaaggcaacagaactggaccaagaaaattcataactttttgcttttgtttctactaagatgacatcatacatggctattgatggcagtgctcttgttcccttgcgtcagaagcccaggaggaaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagttcagttgaaaggcgttttttgtgttcctactgggagctcacggtgatgtggggctctaggggggatgtgagaaatgtctcttctgttcattgctctccagagaatgctatggacaagaatcaaattttaccaggagtaattgcccatggaaacattctgtttttcaaaagaagaatgtacatattccacttgactgggaagctgtgtggcccaaatcactgtttgagtggaggaatgttttctagagcagtgactggaaggacaaacgtggtgttgcagaacaaaaattccttgcctttggtatggaatggtggtgccttttccatgtgatgagaaatgcttcatagacagtggcatgtgggagagctgaaggaggaggcgtgttccatattccactcattcaaaggacagcttggtgttttcacactttatgcaggttaggggatctgattaatgtttcctttccttacaacagctagagaaaacatctcatcacaattggagacctctacttcctttgagctttcctactcaatggtaggagataggaatatgttccgcaaagaatgtctactgctcttgtccttggctgtgatccctatacatagtgtgaatttatatccaggtttcccaggatcaatattgacaagacgactttggcatctgaattgttttaatatctttactcaaaaaaacaaaaaaacaaaaacccatggaagcaacaaaagagttaaacatgagggatttatttttgtatgtttatatgtcacttgtgtgctatgtgaatagctatgtttgttatttaaatatatttatagaagttcaaattactagtgtttaaaagatgatatactattatatattgtgcttagtatatatttgatgagtctatactttttgcttgagaaaaatagaaatactattgattcactggtgttatgatgttgcactgtgtctgaggaatgctcaggaaatcttgtgggaaaaaaatggggcatgcattcataatttttcattttcttccccaccccaacccccatgagctcttaaatttagatttctatctcttgtaagtcactcttttaaccagcaaaggactttcatcttagattatcctttctattaaataaactttaagctttgtgccatttatgcctgcaaaccttagaccaaaggcaacacaactaatgtcatcttttcattaaagactaatagaaatttagaaatcattgtgttaaagagagctatagagaaacaatatgaaagtcttcccttactaatcaccatgaatatttctcaccataggaataaccacaacccaccaagtacccatgttggccctgcctacccgtaacaaattgttcacacaacctattttgttttatagcttcaaagtgtggcttgacattcaaatggaaggaaccacctgaattatatctgcaaacaaaatggaaatagttgttgaatagttccccaagctttactaagaagccttaatactctgtaaacaaacaaacaaacaaaaaacaaccttagcattaagaaataaaaacaaaaaacaagaagcaagttgtactgctagaaacttctctaagataagaggccaggccagtcagtttggcccagcaaacatgtgggtacttctccacctagggaagccactgaagatgagtttgacctgtggtgacctgacagagagaacattcagatcctcagattgcaccctgatgccctggtttaggaaagcagtgctttaaccttttgcccctggaaattactgattctttctgtgattagcagataccagaagggaaattatttaggattggcaatgtaaagagtattgaaggaacaacaaataacaatagcagaaataacagtgtgacataaagtgcccttccacctatttttctttggtttgcaacaccagcctgtagacttccagtttttcttaaattgaagagctccagacacttttgagcagggtttgtgaatagctttgaatgctttcctttggcttttcgtgaagacatatttccccagcctttcaactgtaaactcctttagtaccattgaaacttaaggcaaaaaagatccctgggattacttagccaaggcttaaatttatttttcaaagtcaagaacattagcctagaagtttttgctttgctagttaaagcttactttgcagagcttcccaaagtgaaagggaaactgaacttcacaattttgcacctggctttctggagccccattgcctgctcattcgtgtttttccccctgtaaattattttgcttttgaccaggttgtgctagaaagtagggctgcttctgtgagttctcagcctaggctgtggccactaagacgtgggtggggggatagacaggagtgagagggagagtgggtgacactttccgtgacacttaatgtaggaagacatgggcttctctctcttggcctcaagccacttttctggtccaaagaatattgggaaaactggattactttcagtatatttcttgagaccgggtcatctctgaaatgcatttggggtagtttcctggggtccaagggccaattcctatacccagtcctgcagtgtctgtgagctgtggaatgagagagaaaaccatggctgctcaggaaggaagtggagaatctctcagcacacgtagatccaaatctgtggcacctgctaaagattaggatttggagaggactcctctttggggttgtgaagaggaccttttccctctgttgttagcctgtagatccagaacggagcctgatgtgatgccttcactggttgatatattgcaaatagacactctgagccctgcattgcaagggcgtcttttgctttaaagaattcttagttttgccacaacagctcaaatctcagaataggatcaaaggcctagaaagactcctaaagtataggattacaaagactccaggaagcgtaagaaagagattgtgtttggagtcagatttcaatgtgaaacccatgccttacatttacacagcactttgtagtttgcaaattggtgtgttttcagccccctcccgctgccccatgctctgagatgattgtggattattacagtgaagtgcctggcccggagcccccagtgatgaagcaggaacttgagtctcaggactcccagcggctctctgcccatttcctcctctccgccccccacctcgcttcacctgttaccttgtgaagttgctgttggcacatagcccactaggaaaccaagaagtttgactgggagcgtgtgtttcattgcactgggcttagcatacggctggccctggtggctgtttggctaaattctccatttgaaacctaaagggccctctctgtgcttgagcacagtctcctcctagtggtcctgcctcaacctgctggcgggctgtctatggattggggtttcacctaatcatgctgtgtttcctttcttttctttctgtacattagactacttgggaggtgctgtgtgatccttggatgaaaaacatatatttaaagaaatggagagtgtttattttgtttgctttttgaggcatgtgctgtcaaatgttagagaccaaacttagtgattagaggttggtcctttgaccttcttctcttaattgcttttcatgtaatcatgataatttactcaggtagcactccagtcacaaacaatgtcacagagatgaaacagattcaaagaaaaaatatttttaagtcttttgaaaagaagtgctattcaaatttaagacatgtttaaattcataggtacattatctcttagtaagaaatacttttttttttctttttttagacagagtcttgctctgttgcccaggctggagtgcagtggcacgattttagctcactgcaacctctgcctccctggttgaagtgattctcctgcctcagcctcccgagtagctgggactacgcccggctaatttttatatttttagtagagaccggggtttaccatgttgcccaggctggtttcaaactcctgacctcaggtgatctgcctgcctctgcctcccagagtgctgggattacaggtgtgagccaccacacctggccgaaagacagtattttgatatagccacatacatgatttaatgagtaatgttaagtacagaaaagctgccatatccacatagttttagggggcatttcttcttcagtctaacaagaatatgatatccaattgtggttttccaatttatttctcttccaatttcttttgtatacctcacaggagaaattgaatcctagaactgggagatgactgccctgcccagggttttgtaatacataattgaaaataaaagtccctgaaactaaatgtttgcagcctgtatgaaatggactgtggaagggggataatttctctcctcacagaaagccactcgtctccttgaatgaggcattgagcagacacacgtttctctgtgtcgtggggcaggaagcaattcccttgcctcttcagcacatctcagttctttcccacatgaccccagaaccacatagaaaacattgaaaataatggattcttcattgtatttgaattttttttttttaacctttagcccaaaagggaagtgtgcctcgtggaaagagcaaatgccgtaaaatagaaaccaggagttttaatcgccatatattttaatgtgcttgcatgatgggaatgtgacttttagcactgcatggtgtttgggggcaagatattaatgtggaaatcttagcttaagttttactgtgctctcatcctgtgtcagctacccctctaaactgaaaaagaggcatggctcatttctctcctgctttatgtttttgaggttgacttgtaagataaaaataaaaataagaaaaaaatatatctaggcaaatgacatgaaaaaaaagttgaaatatactactggtgttcatttttgtcctgcagtgttgctttctcaaagaaataaacatgtggctggaagtgtttaa

SEQ ID NO: 2878 - DNA, 1658 bp, Homo sapiens
gtactatgaggcttctgaatccaggaataagactgctcttggatttactctctttgtattgcatgtcaaaggcaacagaactggaccaagaaaattcataactttttgcttttgtttctactaagatgacatcatacatggctattgatggcagtgctcttcaggttcccttgcgtcagaagcccaggaggaaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagt

SEQ ID NO: 2879 - DNA, 3267 bp, Homo sapiens
acatgtagtcttctcactttcttcttgccatgagactgagagagtgctccttgggacggagtttcagagtcatcaactgggctcatgagaaccacaagaaacctacgaaggcactgggacagagcctggctgctggtcaaaggcaacagaactggaccaagaaaattcataactttttgcttttgtttctactaagatgacatcatacatggctattgatggcagtgctcttcaggttcccttgcgtcagaagcccaggaggaaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagttcagttgaaaggcgttttttgtgttcctactgggagctcacggtgatgtggggctctaggggggatgtgagaaatgtctcttctgttcattgctctccagagaatgctatggacaagaatcaaattttaccaggagtaattgcccatggaaacattctgtttttcaaaagaagaatgtacatattccacttgactgggaagctgtgtggcccaaatcactgtttgagtggaggaatgttttctagagcagtgactggaaggacaaacgtggtgttgcagaacaaaaattccttgcctttggtatggaatggtggtgccttttccatgtgatgagaaatgcttcatagacagtggcatgtgggagagctgaaggaggaggcgtgttccatattccactcattcaaaggacagcttggtgttttcacactttatgcaggttaggggatctgattaatgtttcctttccttacaacagctagagaaaacatctcatcacaattggagacctctacttcctttgagctttcctactcaatggtaggagataggaatatgttccgcaaagaatgtctactgctcttgtccttggctgtgatccctatacatagtgtgaatttatatccaggtttcccaggatcaatattgacaagacgactttggcatctgaattgttttaatatctttactcaaaaaaacaaaaaaacaaaaacccatggaagcaacaaaagagttaaacatgagggatttatttttgtatgtttatatgtcacttgtgtgctatgtgaatagctatgtttgttatttaaatatatttatagaagttcaaattactagtgtttaaaagatgatatactattatatattgtgcttagtatatatttgatgagtctatactttttgcttgagaaaaatagaaatactattgattcactggtgttatgatgttgcactgtgtctgaggaatgctcaggaaatcttgtgggaaaaaaatggggcatgcattcataatttttcattttcttccccaccccaacccccatgagctcttaaatttagatttctatctcttgtaagtcactcttttaaccagcaaaggactttcatcttagattatcctttctattaaataaactttaagctttgtgccatttatgcctgcaaaccttagaccaaaggcaacacaactaatgtcatcttttcattaaagactaatagaaatttagaaatcattgtgttaaagagagctatagagaaacaatatgaaagtcttcccttactaatcaccatgaatatttctcaccataggaataaccacaacccaccaagtacccatgttggccctgcctacccgtaacaaattgttcacacaacctattttgttttatagcttcaaagtgtggcttgacattcaaatggaaggaaccacctgaattatatctgcaaacaaaatggaaatagttgttgaatagttccccaagctttactaagaagccttaatactctgtaaacaaacaaacaaacaaaaaacaaccttagca

SEQ ID NO: 2880 - DNA, 485 bp, Homo sapiens
gactgagtttccagagctgaggctgctttaagtagaatcctcaagcttggcctcagagtactatgaggcttctgaatccaggaataagactgctcttggatttactctctttgtattgcatagtcatcaactgggctcatgagaaccacaagaaacctacgaaggcactgggacagagcctggctgctggtcaaaggcaacagaactggaccaagaaaattcataactttttgcttttgtttctactaagatgacatcatacatggctattgatggcagtgctcttgttcccttgcgtcagaagcccaggaggaaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagca

SEQ ID NO: 2881 - DNA, 396 bp, Homo sapiens
atgttttcagataattcacattgccctgattgtggacaacagtggttccctagtttagaactaggccactggttgtaccaaactgaacttgttgaaaatgaatgttaccaggtattcttagaccgtattaacagagctgattattgtcctgagtgttatcctgataatcctgctaatagaagccttgttcttccttggtctttcccacttgagtgggctccccagaatctcaccagatggacctttgagaaagcttgccatccatttcttctgggtcctccactggttagaaaaagaatacatgactctcgagtagctggttttaaccctgcattacagttaatcttgaccagaacagataaaaccttaaacaaaaaactgggccaaaacaaatag

SEQ ID NO: 2882 - DNA, 3706 bp, Homo sapiens
aagggttcagagtcaggcacaggcaggcagacaggaccccaagcaggactggccttccagacaggaaagagggttgcggagacacaggaggccagttgagagtggcagaggagaaaggagtttcatgggaggatggggcttggagagagatgagggagggaaaacgggggccgccatgcatcctcagcttccgggggactttggagagggtcgaggctcagtgggagctggaggcccagggccccggccagtgcccagccccgctgggagacccggccagcaccacggacggcgcccaggaagcccgagtccccctggacggggccttctggattccgaggcccccggcaggttcgcccaagggctgcttcgcttgcgtgtccaagccccctgccctgcaggctccggcggcccctgcccctgagccctcggcctctcccccgatggcgcccacactgttccccatggagtccaagagcagcaagaccgacagcgtgcgggctgccggcgcgccccctgcctgcaagcacctagccgagaagaagacgatgaccaaccccacgaccgtcatcgaggtctacccggacaccaccgaggtgaacgactattacctgtggtccatcttcaacttcgtctacctcaacttctgctgcctgggcttcatcgccttggcctactccctcaaagtgcgagacaagaagcttctcaatgacctgaatggagccgtggaggatgcaaagacggcccggctgttcaacatcaccagttctgccctggcagcctcctgcatcatcctcgtcttcatcttcctgcggtaccccctcaccgactactaaggcccgccaggcacggctgctggcggagacaagcactgagacatgtttattctcatggtccctgaaacgcaggatcccatgaggttggggcagggcagggcttcttgtcctggggcccccttgagctgtgaactgggcagcaaggccatcagaagctgagtacagcaagggggcagtgagcttggccctcagtccaccccctccgcctcctggcctccaccctgcctgtgtctggggcctgggggcttctcccctcgctgctgcaccctggcttccagcgtctgtgtccctgccctcacgtgccccttcccaggctcctggggccccttggacctgacacctagcaggaagggcttatgcaaaattgtcccaggttgggaggactcactctgtgctccccgaccctgcctcctccacgatgtgaccccgctcagagcccttgtgtctgtgaactttcaatgaaatacccatgcagctccagcccagccttctactttgtgtccctggcagggcctggagaagtctggaggctttgcaatcctccctcaggaactgcctggcggtcagggccccgggtgctgtgtcccaacagactgcaggggacggtctgctccatcacagctgtgccagacagtgaatgggaagggggggcatttggtggaggtaccccaaactcgagtcacttagagggtcaggcagcctcctggggggacggaagggggtggggcacagcctcagctgcctgcattggccaaatcagagcaaaggaaaccacaaattcactcggaaggaagcagcaggcagagacgatagacgcctggctaacccctgtccctcctggagggctctgggacctggacaggcccctttacctctctcgtgcccatctccttagctgtaaaataggaaaatggcctttcacttctataatcactgtgaaaatgaacggaagatgcctttcaaaggccgaggccagcgccctgacggcccatggcatgtgcagtccacaatgtgggaggcaggatgcagggatgggctctgtccccttggaactcaggcacagtcatgggggtgccggtcagccctgaagacaagctgatgagggtgcactaggaaaagtgcagggcatcggcgaggcacacgaaggaggtggggaggtgaagatggagaagaagccgaggcagtggccatgggtgtggagcttcgcgctgtgggtgcccagctggtctgggaaaccgcaggaaatcccgcagctcaggtgcgcagtgggaaggacttgctattccgtgggaaggcaggcaaaccttcccagggaaggggcatggccgtgcgcctcatgttttgggaagctcgtgccctctggggtagcgaggccagcttggaggggagtccagtggacagaggtggatgcaagtggagggagctgagcctgggctggggctggcagcagagggctggacagcagggcgcctgcgtggcagctgtgcagtcagtggggttgactggtttggaaggtaaggtgggggagaagcccggaggattcctgtcccttgacttggacagcccagtggagagggctgtgtaccaagggcaggaaaccagggagaagaagatgttgactttaagataccaagcagagaagggaagagccttctgggctggagacgtggggtgcctcagaagggaggaccttgagctagcagcagatgggacaaacgcaggggacagggcacagccgtggcaggagtgcagcgagcaagattctggtcacagtcctgacccagaaacctgcagaggaagggagggtggccagcacctgcccgtgggcctggggtgcagcccaggcagaggtggatggagggggtgctcagggaagaggggaggggagtgtgtgacctcaaaatgggagggcttgggggtcagagtcgagagaggggacagggtggggaccatgtgggactcttgagcactgacccttgaacccaggcagtggtgggatgggagggcaggaggcggcgggctgcgaggctgatgcggggctgcacggagctgtcattgagcctcttggaggatggtgggagaagtgccaggggcggctgaaagccttgccgagactgtgggcagcctggttgtgggcacttcggatgcttgcaccattagacccagaggcttcctggacaagcctgggctggaagaggatggcagaggctgctgggccttggaagagagagggtcctggcttctagttcctggggcagctaaggccaaccccagtgtccaggtgtcttccatgttatgcctgggagggaagaaagtagaggggcaaatgctttctttgcctattttccttaaacatttggtggcagtgctggtggctgcctgggacaggggccaggaggaaacacccctgcattagggaagccctcagccagcttttccctgggatgttcctgcgcctggctgaagctttctgagttcatgttggggaaatggaacggtcaccttccagccagtaaaggcacccctagctcttgggatgtttgtatccaactccgggcaatgtggggctacaaaggcccctggcttccataccctggggaccgggggagggctggtgctcccgcggtgggtgtccacggtgaggtcaggcccccacagcaggtgcattctcgccctcagcaggcaggcaagcaggcatcagctccggcgctggtctctggcttcgaagtctgtgtctttgcctgtctgtactcatgcctgacctgctggcgctccctgtccactgcactcctcccacctcatttttatgtgattttgcacagtgcctggcagacatttgacattcaataaacattgtacgaacgaaagaa

SEQ ID NO: 2883 - DNA, 736 bp, Homo sapiens
accagtctgagtgtggaagagacggcgctggaacccatggacacggcgtatccccgcgaggacacccgggcccccacgcccagcaaggccggtgcccacacagccctcacactgggggccccgcaccccccgcctcgagaccacttgatctggtcggtgttcagcaccctctacctgaatctgtgttgcctcggcttcctggcgctggcctactccatcaaggcccgagatcagaaggtggttggtgacctggaagcggcccggcgttttggctccaaagccaagtgctacaacatcctggccgcgatgtggacgctggtgccgccactgctgctcctggggctggtggtgactggtgccctgcacctggcccggctggccaaggactctgccgccttcttcagcaccaagtttgatgacgcggactatgactgacaggctgggtcctgatctggggcactagccccaggacactgaccccaggctgctgcccctggggcccaatactgactccccggagcctggccctccttctgtggggcctccatccctgccccatcctgatcctggggccctccagccccaacatgggcacctaaggctgaaccagtcagaccccggggtcttcaccctaacccgagagttcccgggccctaactctgcccccgatcctgcccctccctcctcacactccaggcccctcggttccacgattaaaagtgcctggttccagaaa

SEQ ID NO: 2884 - DNA, 1992 bp, Homo sapiens
ccggccctccgcttccccgcgagacgaaacttcccgtcccggcggctctggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggcc

SEQ ID NO: 2885 - DNA, 1801 bp, Homo sapiens
cagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaaca

SEQ ID NO: 2886 - DNA, 1761 bp, Homo sapiens
gagacgaaacttcccgtcccggcggctctggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgagaaggcccaggcacggaccagactgaggcagaggcccccgcagctgtcccaccaccacaggcccagggctccctgctggggagctgtacgggtgggcagtagagacgacccccagccccgggccccagcccgcggcactaacgacaggtgagaggggtaggggttgggaggcctggggcacagggagaggctagggatgaggtgccagcacaggattcccttccggatgcaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtct

SEQ ID NO: 2887 - DNA, 2051 bp, Homo sapiens
agggtgcgaagcgccactgtttaggtttcgctttcccgggagcctgacccgcccctgacgtcgcctttcccgtctccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaaca

SEQ ID NO: 2888 - DNA, 1885 bp, Homo sapiens
gaaactcccgcctggccaccataaaagcgccggccctccgcttccccgcgagacgaaacttcccgtcccggcggctctggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaaca

SEQ ID NO: 2889 - DNA, 1968 bp, Homo sapiens
gaaactcccgcctggccaccataaaagcgccggccctccgcttccccgcgagacgaaacttcccgtcccggcggctctggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccag

SEQ ID NO: 2890 - DNA, 674 bp, Homo sapiens
gcttggggcgctggcacctcctcttacagctttactcctgccagcttgggaaaaggccggagaaggtgaaattctgtgtgctccctccggcgagagactttgtcagctcccgcacagtaacctttattcaaaccagatcctgaataaagtcaaaactcaaccaacaggtggaagtccaagaatccgagtggaggctcaccgaggcgaaggggccaaccatgggaaaggagagtggatgggactcaggcagggctgctgtagcagctgtggtcggaggagttgtggctgtggggactgtgctcgtggcgctcagtgccatgggcttcacctcagtaggaatcgccgcatcctccatagcagccaagatgatgtctacagcagccattgccaacgggggcggagttgctgctggcagtctggtggctattctgcagtcagtgggggcagctggactctctgtgacatctaaagttatcgggggctttgctgggacagctcttggggcctggctgggttcacccccttccagctgaacaccacactgaggcagggagttggctctcttggtggagatgactttcctgggcctctggatgacaatcttccaaaggacaagtctcctactcccaaaactatttaaggaagcatgaaaaataaagatgctggttatcttc

SEQ ID NO: 2891 - DNA, 680 bp, Homo sapiens
cctgattggctgcctcgcggaccgcagcagtgccggcgggagagctggcttggggcgctggcacctcctcttacagctttactcctgccagcttgggaaaaggccggagaaggtgaaattctgtgtgctccctccggcgagagactttgtcagctcccgcacagtaacgtggaagtccaagaatccgagtggaggctcaccgaggcgaaggggccaaccatgggaaaggagagtggatgggactcaggcagggctgctgtagcagctgtggtcggaggagttgtggctgtggggactgtgctcgtggcgctcagtgccatgggcttcacctcagtaggaatcgccgcatcctccatagcagccaagatgatgtctacagcagccattgccaacgggggcggagttgctgctggcagtctggtggctattctgcagtcagtgggggcagctggactctctgtgacatctaaagttatcgggggctttgctgggacagctcttggggcctggctgggttcacccccttccagctgaacaccacactgaggcagggagttggctctcttggtggagatgactttcctgggcctctggatgacaatcttccaaaggacaagtctcctactcccaaaactatttaaggaagcatgaaaaataaagatgctggttatcttctccta

SEQ ID NO: 2892 - DNA, 511 bp, Homo sapiens
ctagggcagagtaggcgcgtccctactggatggagggggaagtaacaccccaagaacgctgtcatttcctgggccaagttgggacccggacggcctcaccatgatgaaacgggcagctgctgctgcagtgggaggagccctggcagtgggggctgtgcccgtggtgctcagtgccatgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgttgggggcctgcttggggaattcaccttcttcttctctcccagctgaacccgaggctaaagaagatgaggcaagagaaaatgtaccccaaggtgaacctccaaaacccccactcaagtcagagaaacatgaggaataaaggtcacatgcagatgca

SEQ ID NO: 2893 - DNA, 822 bp, Homo sapiens
gtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggtgagaatgcgggtaaggatgcaggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaaca

SEQ ID NO: 2894 - DNA, 841 bp, Homo sapiens
aaaagccagccttcagccggagaaccgtttactcgctgctgtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaacactt

SEQ ID NO: 2895 - DNA, 828 bp, Homo sapiens
agaaccgtttactcgctgctgtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggtgagaatgcgggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaa

SEQ ID NO: 2896 - DNA, 1963 bp, Homo sapiens
gccccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcagcattgggaatggtaccacctcccgaaaatgtcagaatgaattctgttaatttcaagaacattctacagtgggagtcacctgcttttgccaaagggaacctgactttcacagctcagtacctaagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacaccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacgaaacggtcccctcctggatggtggccgtcatcctcatggcctcggtcttcatggtctgcctggcactcctcggctgcttcgccttgctgtggtgcgtttacaagaagacaaagtacgccttctcccctaggaattctcttccacagcacctgaaagagtttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggctctgagaaggaaacacactcggctgggcacagtgacgtactccatctcacatctgcctcagtgagggatcagggcagcaaacaagggccaagaccatctgagccagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaataccagcaccttagaggtcgaggcaggcggatcacttgaggtcaggagttcaagaccagcctggccaatatggtgaaacccagtctctactaaaaatacaaaaattagctaggcatgatggcgcatgcctataatcccagctactcgagtgcctgaggcaggagaattgcatgaacccgggaggaggaggaggaggttgcagtgagccgagatagcggcactgcactccagcctgggtgacaaagtgagactccatctcaaaaaaaaaaaaaaaaaaaattgtgagaaacagaaatacttaaaatgaggaataagaatggagatgttacatctggtagatgtaacattctaccagattatggatggactgatctgaaaatcgacctcaactcaagggtggtcagctcaatgctacacagagcacggacttttggattctttgcagtactttgaatttatttttctacctatatatgttttatatgctgctggtgctccattaaagttttactctgtgttgcactatatgtgttcatgata

SEQ ID NO: 2897 - DNA, 1215 bp, Homo sapiens
tccgtccatggcgtggagccttgggagctggctgggtggctgcctgctggtgtcagcattgggaatggtaccacctcccgaaaatgtcagaatgaattctgttaatttcaagaacattctacagtgggagtcacctgcttttgccaaagggaacctgactttcacagctcagtacctaagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacaccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacgaaacggtcccctcctggatggtggccgtcatcctcatggcctcggtcttcatggtctgcctggcactcctcggctgcttcgccttgctgtggtgcgtttacaagaagacaaagtacgccttctcccctaggaattctcttccacagcacctgaaagagtttttgggccatcctcatcataacacacttctgtttttctcctttccattgtcggatgagaatgatgtttttgacaagctaagtgtcattgcagaagactctgagagcggcaagcagaatcctggtgacagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaataccagcaccttagaggtcgaggcaggcggatcacttgaggtca

SEQ ID NO: 2898 - DNA, 1884 bp, Homo sapiens
cagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacaggctggagtgcagtggtgcaatctcagcttactgcaacctccgccagtgaggcccttcattagacactaatttgaagctatggcattcccccactatgagcccacctgtcagccaggctatctgccttgatcctagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtctcctgaggaactcctcagggcctggatctcataggtttgcggaagggcccaggtgaagccgagaacctggtctgcatgacatggaaaccatgaggggacaagttgtgtttctgttttccgccacggacaagggatgagagaagtaggaagagcctgttgtctacaagtctagaagcaaccatcagaggcagggtggtttgtctaacagaacactgactgaggcttaggggatgtgacctctagactgggggctgccacttgctggctgagcaaccctgggaaaagtgacttcatcccttcggtcctaagttttctcatctgtaatgggggaattacctacacacctgctaaacacacacacacagagtctctctctatatatacacacgtacacataaatacacccagcacttgcaaggctagagggaaactggtgacactctacagtctgactgattcagtgtttctggagagcaggacataaatgtatgatgagaatgatcaaggactctacacactgggtggcttggagagcccactttcccagaataatccttgagagaaaaggaatcatgggagcaatggtgttgagttcacttcaagcccaatgccggtgcagaggggaatggcttagcgagctctacagtaggtgacctggaggaaggtcacagccacactgaaaatgggatgtgcatgaacacggaggatccatgaactactgtaaagtgttgacagtgtgtgcacactgcagacagcaggtgaaatgtatgtgtgcaatgcgacgagaatgcagaagtcagtaacatgtgcatgtttgttgtgctccttttttctgttggtaaagtacagaattcagcaaataaaaagggccaccctggccaaaagcggtcttt

SEQ ID NO: 2899 - DNA, 2047 bp, Homo sapiens
aaagttacattttctctggaactctcctaggccactccctgctgatgcaacatctgggtttgggcagaaaggagggtgcttcggagcccgccctttctgagcttcctgggccggctctagaacaattcaggcttcgctgcgactcagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtctcctgaggaactcctcagggcctggatctcataggtttgcggaagggcccaggtgaagccgagaacctggtctgcatgacatggaaaccatgaggggacaagttgtgtttctgttttccgccacggacaagggatgagagaagtaggaagagcctgttgtctacaagtctagaagcaaccatcagaggcagggtggtttgtctaacagaacactgactgaggcttaggggatgtgacctctagactgggggctgccacttgctggctgagcaaccctgggaaaagtgacttcatcccttcggtcctaagttttctcatctgtaatgggggaattacctacacacctgctaaacacacacacacagagtctctctctatatatacacacgtacacataaatacacccagcacttgcaaggctagagggaaactggtgacactctacagtctgactgattcagtgtttctggagagcaggacataaatgtatgatgagaatgatcaaggactctacacactgggtggcttggagagcccactttcccagaataatccttgagagaaaaggaatcatgggagcaatggtgttgagttcacttcaagcccaatgccggtgcagaggggaatggcttagcgagctctacagtaggtgacctggaggaaggtcacagccacactgaaaatgggatgtgcatgaacacggaggatccatgaactactgtaaagtgttgacagtgtgtgcacactgcagacagcaggtgaaatgtatgtgtgcaatgcgacgagaatgcagaagtcagtaacatgtgcatgtttgttgtgctccttttttctgttggtaaagtacagaattcagcaaataaaaagggccaccctggccaaaagcggtctttaaa

SEQ ID NO: 2900 - DNA, 2798 bp, Homo sapiens
gcagagtagaggccaagggagggctctgtgccagccccgatgaggacgctgctgaccatcttgactgtgggatccctggctgctcacgcccctgaggacccctcggatctgctccagcacgtgaaattccagtccagcaactttgaaaacatcctgacgtgggacagcgggccggagggcaccccagacacggtctacagcatcgagtataagacgtacggagagagggactgggtggcaaagaagggctgtcagcggatcacccggaagtcctgcaacctgacggtggagacgggcaacctcacggagctctactatgccagggtcaccgctgtcagtgcgggaggccggtcagccaccaagatgactgacaggttcagctctctgcagcacactaccctcaagccacctgatgtgacctgtatctccaaagtgagatcgattcagatgattgttcatcctacccccacgccaatccgtgcaggcgatggccaccggctaaccctggaagacatcttccatgacctgttctaccacttagagctccaggtcaaccgcacctaccaaatgcaccttggagggaagcagagagaatatgagttcttcggcctgacccctgacacagagttccttggcaccatcatgatttgcgttcccacctgggccaaggagagtgccccctacatgtgccgagtgaagacactgccagaccggacatggacctactccttctccggagccttcctgttctccatgggcttcctcgtcgcagtactctgctacctgagctacagatatgtcaccaagccgcctgcacctcccaactccctgaacgtccagcgagtcctgactttccagccgctgcgcttcatccaggagcacgtcctgatccctgtctttgacctcagcggccccagcagtctggcccagcctgtccagtactcccagatcagggtgtctggacccagggagcccgcaggagctccacagcggcatagcctgtccgagatcacctacttagggcagccagacatctccatcctccagccctccaacgtgccacctccccagatcctctccccactgtcctatgccccaaacgctgcccctgaggtcgggcccccatcctatgcacctcaggtgacccccgaagctcaattcccattctacgccccacaggccatctctaaggtccagccttcctcctatgcccctcaagccactccggacagctggcctccctcctatggggtatgcatggaaggttctggcaaagactcccccactgggacactttctagtcctaaacaccttaggcctaaaggtcagcttcagaaagagccaccagctggaagctgcatgttaggtggcctttctctgcaggaggtgacctccttggctatggaggaatcccaagaagcaaaatcattgcaccagcccctggggatttgcacagacagaacatctgacccaaatgtgctacacagtggggaggaagggacaccacagtacctaaagggccagctccccctcctctcctcagtccagatcgagggccaccccatgtccctccctttgcaacctccttcccgtccatgttccccctcggaccaaggtccaagtccctggggcctgctggagtcccttgtgtgtcccaaggatgaagccaagagcccagcccctgagacctcagacctggagcagcccacagaactggattctcttttcagaggcctggccctgactgtgcagtgggagtcctgaggggaatgggaaaggcttggtgcttcctccctgtccctacccagtgtcacatccttggctgtcaatcccatgcctgcccacgccacacactctgcgatctggcctcagacgggtgcccttgagagaagcagagggagtggcatgcagggcccctgccatgggtgcgctcctcaccggagcaaagcagcatgataaggactgcagcgggggagctctggggagcagcttgtgtagacaagcgcgtgctcgctgagccctgcaaggcagaaatgacagtgcaaggaggaaatgcagggaaactcccgaggtccagagccccacctcctaacaccatggattcaaagtgctcagggaatttgcctctccttgccccattcctggccagtttcacaatctagctcgacagagcatgaggcccctgcctcttctgtcattgttcaaaggtgggaagagagcctggaaaagaaccaggcctggaaaagaaccagaaggaggctgggcagaaccagaacaacctgcacttctgccaaggccagggccagcaggacggcaggactctagggaggggtgtggcctgcagctcattcccagccagggcaactgcctgacgttgcacgatttcagcttcattcctctgatagaacaaagcgaaatgcaggtccaccagggagggagacacacaagccttttctgcaggcaggagtttcagaccctatcctgagaatggggtttgaaaggaaggtgagggctgtggcccctggacgggtacaataacacactgtactgatgtcacaactttgcaagctctgccttgggttcagcccatctgggctcaaattccagcctcaccactcacaagctgtgtgacttcaaacaaatgaaatcagtgcccagaacctcggtttcctcatctgtaatgtggggatcataacacctacctcatggagttgtggtgaagatgaaatgaagtcatgtctttaaagtgcttaatagtgcctggtacatgggcagtgcccaataaacggtagctattt

SEQ ID NO: 2901 - DNA, 3258 bp, Homo sapiens
aaggctgtggaccccagagaaggtggcaggtggcccccctaggagagctctgggcacattcgaatcttcccaaactccaataataaaaattcgaagactttggcagagagtgtgtgtgtgtgtgtatggttgttgggcgtaggacaggtttcggggatgcgcggtacgcggtaccacccctcggaggcccccacccccagacgcccaggccgcctccccactccccctcaagcagccccagccggggactttccgtcgcggggaaggggcggggaccctgagcgaaaggtgcggaggcggcctgccggggtggttcggcttcccgttgccgcctcgggcgctgtacccagagctcgaagaggagcagcgcggccgcgcggacccggcaaggctgggccggactcggggctcccgagggacgccatgcggggaggcaggggcgcccctttctggctgtggccgctgcccaagctggcgctgctgcctctgttgtgggtgcttttccagcggacgcgtccccagggcagcgccgggccactgcagtgctacggagttggacccttgggcgacttgaactgctcgtgggagcctcttggggacctgggagccccctccgagttacacctccagagccaaaagtaccgttccaacaaaacccagactgtggcagtggcagccggacggagctgggtggccattcctcgggaacagctcaccatgtctgacaaactccttgtctggggcactaaggcaggccagcctctctggccccccgtcttcgtgaacctagaaacccaaatgaagccaaacgccccccggctgggccctgacgtggacttttccgaggatgaccccctggaggccactgtccattgggccccacctacatggccatctcataaagttctgatctgccagttccactaccgaagatgtcaggaggcggcctggaccctgctggaaccggagctgaagaccatacccctgacccctgttgagatccaagatttggagctagccactggctacaaagtgtatggccgctgccggatggagaaagaagaggatttgtggggcgagtggagccccattttgtccttccagacaccgccttctgctccaaaagatgtgtgggtatcagggaacctctgtgggacgcctggaggagaggaacctttgcttctatggaaggccccagggccctgtgtgcaggtgagctacaaagtctggttctgggttggaggtcgtgagctgagtccagaaggaattacctgctgctgctccctaattcccagtggggcggagtgggccagggtgtccgctgtcaacgccacaagctgggagcctctcaccaacctctctttggtctgcttggattcagcctctgccccccgtagcgtggcagtcagcagcatcgctgggagcacggagctactggtgacctggcaaccggggcctggggaaccactggagcatgtagtggactgggctcgagatggggaccccctggagaaactcaactgggtccggcttccccctgggaacctcagtgctctgttaccagggaatttcactgtcggggtcccctatcgaatcactgtgaccgcagtctctgcttcaggcttggcctctgcatcctccgtctgggggttcagggaggaattagcacccctagtggggccaacgctttggcgactccaagatgcccctccagggacccccgccatagcgtggggagaggtcccaaggcaccagcttcgaggccacctcacccactacaccttgtgtgcacagagtggaaccagcccctccgtctgcatgaatgtgagtggcaacacacagagtgtcaccctgcctgaccttccttggggtccctgtgagctgtgggtgacagcatctaccatcgctggacagggccctcctggtcccatcctccggcttcatctaccagataacaccctgaggtggaaagttctgccgggcatcctattcttgtggggcttgttcctgttggggtgtggcctgagcctggccacctctggaaggtgctaccacctaaggcacaaagtgctgccccgctgggtctgggagaaagttcctgatcctgccaacagcagttcaggccagccccacatggagcaagtacctgaggcccagccccttggggacttgcccatcctggaagtggaggagatggagcccccgccggttatggagtcctcccagcccgcccaggccaccgccccgcttgactctgggtatgagaagcacttcctgcccacacctgaggagctgggccttctggggccccccaggccacaggttctggcctgaaccacacgtctggctgggggctgccagccaggctagagggatgctcatgcaggttgcaccccagtcctggattagccctcttgatggatgaagacactgaggactcagagaggctgagtcacttacctgaggacacccagccaggcagagctgggattgaaggacccctatagagaagggcttggcccccatggggaagacacggatggaaggtggagcaaaggaaaatacatgaaattgagagtggcagctgcctgccaaaatctgttccgctgtaacagaactgaatttggaccccagcacagtggctcacgcctgtaatcccagcactttggcaggccaaggtggaaggatcacttagagctaggagtttgagaccagcctgggcaatatagcaagacccctcactacaaaaataaaacatcaaaaacaaaaacaattagctgggcatgatggcacacacctgtagtccgagccacttgggaggctgaggtgggaggatcggttgagcccaggagttcgaagctgcagggacctctgattgcaccactgcactccaggctgggtaacagaatgagaccttatctcaaaaataaacaaactaataaaaagcaaaaaaaaaaaaaaaagaaaagaaaaaacactgcatttgggcaccatctcagctcccttgcatccaggtgcagcatggactgagttcttgacaacagaatgtggtcagaagtgacatatgccaacacggggtctgggtgggggctcccccacatcctttccttgcctatgagctggaacataacacatgcctatgatccagctttggtcatacccaaggggaaggtggagcaagaaatgaaaaggaacctgaatccctgaatgactgcatggatagaaccactaagaaaaataaacttttatatttttata

SEQ ID NO: 2902 - DNA, 612 bp, Homo sapiens
ttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcactcactgacctgtgcttttgaggacccagatgtcaacatcaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactataggtaagaagttgtatataaaagtatggttgtcacttttgggctacctgaaaacactgtgtctggacattctgtaggttaaaagtagacaaatagtggaaacaactggcaatagataatagctaattccctactgtaaatttttataat

SEQ ID NO: 2903 - DNA, 1287 bp, Homo sapiens
gtcttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcactcactgacctgtgcttttgaggacccagatgtcaacatcaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcgtctatcgggaaggagccaatgactttgtggtgacatttaatacatcacacttgcaaaagaagtatgtaaaagttttaatgcacgatgtagcttaccgccaggaaaaggatgaaaacaaatggacggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctca

SEQ ID NO: 2904 - DNA, 2179 bp, Homo sapiens
cgcagaggccgccgcttccaggaagctctccgggacgccgcgccctcgcctctgggcgcctgcgagtctgcggcccgcaggtgacggagctcacggtaatgtttgactagagtcaccacgctcgtggattttgttttcctatttctgtctttctgaagttcatgtgttgagctcacatgttgctgtccggcacctctgaatccacgtgttggcttttccagagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctgacccctctccctcagggccacaggccttggcacctctacctggggatgacgtcaactccgatgattccgacgatattgtcattgcaccgtctctgcccacgaagaactttccagtttag

SEQ ID NO: 2905 - DNA, 6844 bp, Homo sapiens
ccagggggaacgcaggtcgcttacccggctgggtaggtcggcggcctggttgccatggcagcggggtcgcgggccggcgccagggaaggccccgaggctgcgggcggccagggctgcccgcggattcccagacccggacgcccgagccagcaaccctgaggggcggccgggcagcgccgccaccatgttcctgggcaccggggagccggccttggacacgggagatgacagtctgtctgcagtcacctttgactctgatgtggagacgaaagcaaaaaggaaagctttccacaaacctccacccacatcgccaaagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctgacccctctccctcagggccacaggccttggcacctctacctggggatgacgtcaactccgatgattccgacgatattgtcattgcaccgtctctgcccacgaagaactttccagtttaggtccccgtcactgtctccacgccgtgatggcagcgctgccgaggacataggaaccacgactggaaagataatttatcgtgttaggagaagaacgatgatacctacttaacacctcagcatctgcgtcgtgtctctttgtgcttttgtttgtggaaggagacccaaatgcctttactttattctctggggagggccagcggctcgcatccccctcatctccagctgcagctcggatggtggattttcagtgccaacagacacatctgccgtgaactcgcagatgccagggagccctgtagtgacacgttctctgacagcaccttgccgcctgcccacgaccttgaccgtgaggagctgctatccgcaaccagcgccgacaccatgccccctcttcctggtgacaccctcaacaaccaggatttgctcgatctcagcccagcaggccaggcagacacaccccgctgtgccttaggaaggtgtgagaccggcttcccccatccccacagcaaaacacggcctgtcccaagccagtgaggagctaaagacacccaggtccccaaatgatcttactccatgccccacccgctcacaccgtcctttcccgtcacccttgctatcccctggagcactgccctccagagctgcccttcccaggaaggaatttggttggattctgtcactgtggagaccaagattttttaaaattcccaattacaaaagcagcatcacacttgcttctgagaacagcagggtgatgtctgttcccaagctggtggcgggagccttagcctgtgtggggccacccggggaagaggaggagaggagggtgaggaggcaggctcgccgttccaagggacagcataggctcgtggtggggcgtgttgcatctggtgtctgggacagtccccgtcaccccatgtgtgcggcctctgcactcccaagctccatggctgggctgggctgggctgggctgggctgggccgggcgtgcggagcctgtggagccagcagctgcagaggcctaggagggagttcctgggggaagcgcacagtgtccagtgcccatctcttgcttgtgtgtgagattagcccttgctggggcgtcaagaggaagagccttagacctgggcgggccttcaggggcatctagacccctgcacagcccaggcctggtgtctgcatttccacagcacccctgtggggactcctgccggggctggccgctgtctcaggagagacccaatggttagaaagcccctttttacacagctgacagcttctcccaaggcttccgtccacggggacaggcttaacccctgggcgccttttctgcagcatggcggccttctgagtcacctaagctgagcctgggtcattctctgtggcggtcagaaggccgatggccccaacacagtggcttgtgaaagggagagaggaggctctgcatgtccacctgctctatgggaggaggacacaggtgtccccagcccagcctgttctctcccagtcactcagggatggggccacccaaagtgcaggacccgccccaccctgcggttcgaagcctggcccctgtctccacttagcttctgtttctgcagtgggtggaagcgagtcagcggggggcctggcttgtgtacgtgttttccttatttggtctgtgggttgccaagtccatttttttttccactgaactggctggtaacttgatggactgtgtaactgacacaggccctctttagacccctgccttcaccccacccgcccgggtccactccctggggcgctgtcccaagccatccctgcttgccagctcaaagcttcaggtcctaggagccagtccacctcgaaagccctgagaaagtgagacacctgcacattcgctgggggagaccctccgttctcttgtggcagctgctcccacttgttaaaccaagctgtttctgcgggacgtgctcactcttgggaaccagtggcctagagctttgggttacaggcatggagagggctttcctgcctcaggcttggaggccaatgttccatacataaaccgccatgtcctctggtgcagctgggctgctcttttaaaagccagcatccatcttgaagctcgctgggtaaatggcaatgcattctcaagccagtgtcttcagctgatgcccagtgtccagtgctggtcaccagtcccctttgctgggtacagcctgcctggctgttctgtggtcctggaacgctgcagtgtggttttgttccatggagacagtaccaagcggagaggcctccttgcccacggccccagggcctgggggccaggggttctggccctgcggggacttaggcaggaggggaagagaagcccatggagccatgggaggggtgagctgtgggcggggcctagtcatgggaggggtgagctgtgggcggggcgagctgtgggtggggcctagccatgggagaggtgagctgtgaatggggctagctatgggtggggtgagctgtggacagggcctagccatgggaaaggtgagctgtgggcggggcctagtcacgggagaggtgagctgtgggcggggcctagtcatgggaggggtgagctgtggatggggcctagccatgggaggggtgagctgtgagtggggctgagccatgggagcagcaagctggtggagtgggctgggcggagctgtgggggctgctggcagggcctaggaaagtagacaactcccgggggagacgaagtagagagtgagtccccaagaaagggactcctgccccagcgtcaagtgccaaagcaggccccatctaccacttcagggtcgacgttggtggcaggtgttgttcacggtgtactgattgtcactgcaacacctccacatcaccttgaacttcaagaacagcagcaaagctgtatctgctatcagaggctgttaggtagtccagctttaaaataacacactctttctctatcccatgccctttaaacaagcagccacaggagatgtcagtctccagggcctggccccactgtgttgacagcagtcacgtctgttgagctgacactgctgaggctgaagctggccccgtgcaggtggctggtgagccacaggtgcagtacccggaggtgtgctctcccctagaggcctgtccccaactcctcccctagaggcctattcccgctgctcacagacctcagcagaggcaccagctggagggctccagggacatccttggagatacaggaggctttcctggcacagggcacagctcttaggaggcctttgtaggacgctgtctccccagcgtgtcctgctcatccaggatggggagaaagaggaggaggccccaggctcagaagccagggacagactgccgacgattaccaaactgaatccaggcagtgccatgaccctgggtgtcccttggttcacatcacccaccagacagctgcggagagagtgcagggaggggctgggaccaaacaggccagaaaccagcagaaaagaggcagaagtgaggtgggtgtgcctggggcacgaagccagcgccggggggatttcagtggagccttacagccaggctccgtgcggactgtgatgccagagaggcgtgcagcctctgggcaagtcgggagagggcttgggtggtccccacaaggcagaagaggtggaagggccagagaagaccaccaagaccaccgttcccgcaggcctggggtgagtgacctgactgagactagcgggcagagccaagcagggctaaactccaacccagggcccggtgttggacaaagtagctttttctttgctcgtttgtctgtgtattaagaagagactaaaatagccaaacgacgctggtcgcatgcgctggctgtggtctgtctgctgaatgtctatttttgtctcctgacgagacgtgaggaccatgcccttgatccctccgatggaccagaaacccccttccttgcaaaaaaaaggcaattgaattaggaaaagatagcccaacctagctcagatccaccaagataagcacagcaaagcttggctgcatttttgaggaataaaaacctgcagaaagcaccgataaccttcaagatctgaatgagattctattataacccgtctaaacgattgcaaaattcctcctttggttttggaagcagcgtttgctctcccgtggctcggattctctgaggaccagggagttgacacacaaaccccgccatgggtccgagccagctatttctcaaggctcccacctcgccaagctcccaagggcctgctggcagtgcctacgctgtgccaactaccctgtctggtacagaccacggctgggtaagcacccttaaaagcaacagaaatgacgtctggaagctgaaatgtgaaactgtcaagatggcttaggagaggaaggagtggacccgctggtctttggcattttgtatttagaattattctaactttatacataatgtataggccgatcttttggaagggataaggttttcattcttgtgcaactcattattctcattattggccttttaaataaaaagttgttttgcagtgtgccttga

SEQ ID NO: 2906 - DNA, 6690 bp, Homo sapiens
ccagggggaacgcaggtcgcttacccggctgggtaggtcggcggcctggttgccatggcagcggggtcgcgggccggcgccagggaaggccccgaggctgcgggcggccagggctgcccgcggattcccagacccggacgcccgagccagcaaccctgaggggcggccgggcagcgccgccaccatgttcctgggcaccggggagccggccttggacacgagtcaccttatctctctaagccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctgacccctctccctcagggccacaggccttggcacctctacctggggatgacgtcaactccgatgattccgacgatattgtcattgcaccgtctctgcccacgaagaactttccagtttaggtccccgtcactgtctccacgccgtgatggcagcgctgccgaggacataggaaccacgactggaaagataatttatcgtgttaggagaagaacgatgatacctacttaacacctcagcatctgcgtcgtgtctctttgtgcttttgtttgtggaaggagacccaaatgcctttactttattctctggggagggccagcggctcgcatccccctcatctccagctgcagctcggatggtggattttcagtgccaacagacacatctgccgtgaactcgcagatgccagggagccctgtagtgacacgttctctgacagcaccttgccgcctgcccacgaccttgaccgtgaggagctgctatccgcaaccagcgccgacaccatgccccctcttcctggtgacaccctcaacaaccaggatttgctcgatctcagcccagcaggccaggcagacacaccccgctgtgccttaggaaggtgtgagaccggcttcccccatccccacagcaaaacacggcctgtcccaagccagtgaggagctaaagacacccaggtccccaaatgatcttactccatgccccacccgctcacaccgtcctttcccgtcacccttgctatcccctggagcactgccctccagagctgcccttcccaggaaggaatttggttggattctgtcactgtggagaccaagattttttaaaattcccaattacaaaagcagcatcacacttgcttctgagaacagcagggtgatgtctgttcccaagctggtggcgggagccttagcctgtgtggggccacccggggaagaggaggagaggagggtgaggaggcaggctcgccgttccaagggacagcataggctcgtggtggggcgtgttgcatctggtgtctgggacagtccccgtcaccccatgtgtgcggcctctgcactcccaagctccatggctgggctgggctgggctgggctgggctgggccgggcgtgcggagcctgtggagccagcagctgcagaggcctaggagggagttcctgggggaagcgcacagtgtccagtgcccatctcttgcttgtgtgtgagattagcccttgctggggcgtcaagaggaagagccttagacctgggcgggccttcaggggcatctagacccctgcacagcccaggcctggtgtctgcatttccacagcacccctgtggggactcctgccggggctggccgctgtctcaggagagacccaatggttagaaagcccctttttacacagctgacagcttctcccaaggcttccgtccacggggacaggcttaacccctgggcgccttttctgcagcatggcggccttctgagtcacctaagctgagcctgggtcattctctgtggcggtcagaaggccgatggccccaacacagtggcttgtgaaagggagagaggaggctctgcatgtccacctgctctatgggaggaggacacaggtgtccccagcccagcctgttctctcccagtcactcagggatggggccacccaaagtgcaggacccgccccaccctgcggttcgaagcctggcccctgtctccacttagcttctgtttctgcagtgggtggaagcgagtcagcggggggcctggcttgtgtacgtgttttccttatttggtctgtgggttgccaagtccatttttttttccactgaactggctggtaacttgatggactgtgtaactgacacaggccctctttagacccctgccttcaccccacccgcccgggtccactccctggggcgctgtcccaagccatccctgcttgccagctcaaagcttcaggtcctaggagccagtccacctcgaaagccctgagaaagtgagacacctgcacattcgctgggggagaccctccgttctcttgtggcagctgctcccacttgttaaaccaagctgtttctgcgggacgtgctcactcttgggaaccagtggcctagagctttgggttacaggcatggagagggctttcctgcctcaggcttggaggccaatgttccatacataaaccgccatgtcctctggtgcagctgggctgctcttttaaaagccagcatccatcttgaagctcgctgggtaaatggcaatgcattctcaagccagtgtcttcagctgatgcccagtgtccagtgctggtcaccagtcccctttgctgggtacagcctgcctggctgttctgtggtcctggaacgctgcagtgtggttttgttccatggagacagtaccaagcggagaggcctccttgcccacggccccagggcctgggggccaggggttctggccctgcggggacttaggcaggaggggaagagaagcccatggagccatgggaggggtgagctgtgggcggggcctagtcatgggaggggtgagctgtgggcggggcgagctgtgggtggggcctagccatgggagaggtgagctgtgaatggggctagctatgggtggggtgagctgtggacagggcctagccatgggaaaggtgagctgtgggcggggcctagtcacgggagaggtgagctgtgggcggggcctagtcatgggaggggtgagctgtggatggggcctagccatgggaggggtgagctgtgagtggggctgagccatgggagcagcaagctggtggagtgggctgggcggagctgtgggggctgctggcagggcctaggaaagtagacaactcccgggggagacgaagtagagagtgagtccccaagaaagggactcctgccccagcgtcaagtgccaaagcaggccccatctaccacttcagggtcgacgttggtggcaggtgttgttcacggtgtactgattgtcactgcaacacctccacatcaccttgaacttcaagaacagcagcaaagctgtatctgctatcagaggctgttaggtagtccagctttaaaataacacactctttctctatcccatgccctttaaacaagcagccacaggagatgtcagtctccagggcctggccccactgtgttgacagcagtcacgtctgttgagctgacactgctgaggctgaagctggccccgtgcaggtggctggtgagccacaggtgcagtacccggaggtgtgctctcccctagaggcctgtccccaactcctcccctagaggcctattcccgctgctcacagacctcagcagaggcaccagctggagggctccagggacatccttggagatacaggaggctttcctggcacagggcacagctcttaggaggcctttgtaggacgctgtctccccagcgtgtcctgctcatccaggatggggagaaagaggaggaggccccaggctcagaagccagggacagactgccgacgattaccaaactgaatccaggcagtgccatgaccctgggtgtcccttggttcacatcacccaccagacagctgcggagagagtgcagggaggggctgggaccaaacaggccagaaaccagcagaaaagaggcagaagtgaggtgggtgtgcctggggcacgaagccagcgccggggggatttcagtggagccttacagccaggctccgtgcggactgtgatgccagagaggcgtgcagcctctgggcaagtcgggagagggcttgggtggtccccacaaggcagaagaggtggaagggccagagaagaccaccaagaccaccgttcccgcaggcctggggtgagtgacctgactgagactagcgggcagagccaagcagggctaaactccaacccagggcccggtgttggacaaagtagctttttctttgctcgtttgtctgtgtattaagaagagactaaaatagccaaacgacgctggtcgcatgcgctggctgtggtctgtctgctgaatgtctatttttgtctcctgacgagacgtgaggaccatgcccttgatccctccgatggaccagaaacccccttccttgcaaaaaaaaggcaattgaattaggaaaagatagcccaacctagctcagatccaccaagataagcacagcaaagcttggctgcatttttgaggaataaaaacctgcagaaagcaccgataaccttcaagatctgaatgagattctattataacccgtctaaacgattgcaaaattcctcctttggttttggaagcagcgtttgctctcccgtggctcggattctctgaggaccagggagttgacacacaaaccccgccatgggtccgagccagctatttctcaaggctcccacctcgccaagctcccaagggcctgctggcagtgcctacgctgtgccaactaccctgtctggtacagaccacggctgggtaagcacccttaaaagcaacagaaatgacgtctggaagctgaaatgtgaaactgtcaagatggcttaggagaggaaggagtggacccgctggtctttggcattttgtatttagaattattctaactttatacataatgtataggccgatcttttggaagggataaggttttcattcttgtgcaactcattattctcattattggccttttaaataaaaagttgttttgcagtgtgccttg

SEQ ID NO: 2907 - DNA, 542 bp, Homo sapiens
aagcgatcctcccaccttagcctcccgagtagctgggactacagggagatgacagtctgtctgcagtcacctttgactctgatgtggagacgagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcg

SEQ ID NO: 2908 - DNA, 543 bp, Homo sapiens
agaggccgccgcttccaggaagctctccgggacgccgcgccctcgcctctgggcgcctgcgagtctgcggcccgcaggtgacggagctcacggtagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgc

SEQ ID NO: 2909 - DNA, 2170 bp, Homo sapiens
atggcagcggggtcgcgggccggcgccagggaaggccccgaggctgcgggcggccagggctgcccgcggattcccagacccggacgcccgagccagcaaccctgaggggcggccgggcagcgccgccaccatgttcctgggcaccggggagccggccttggacacgaaagcaaaaaggaaagctttccacaaacctccacccacatcgccaaagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctgacccctctccctcagggccacaggccttggcacctctacctggggatgacgtcaactccgatgattccgacgatattgtcattgcaccgtctctgcccacgaagaactttccagtttag

SEQ ID NO: 2910 - DNA, 5988 bp, Homo sapiens
gaaggaggaacatggagaggagagcagcgggcccaggctgggcagcctatgaacgcctcacagctgaggagatggatgagcagaggcggcagaatgttgcctatcagtacctgtgccggctggaggaggccaagcgctggatggaggcctgcctgaaggaggagcttccttccccggtggagctggaggagagccttcggaatggagtgctgctggccaagctaggccactgttttgcaccctccgtggttcccttgaagaagatctacgatgtggagcagctgcggtaccaggcaactggcttacatttccgtcacacagacaacatcaacttttggctatctgcaatagcccacatcggtctgccttcgaccttcttcccagagaccacggacatctatgacaaaaagaacatgccccgggtagtctactgcatccatgctctcagtctcttcctcttccggctgggattggcccctcagatacatgatctatacgggaaagtgaaattcacagctgaggaactcagcaacatggcgtccgaactggccaaatatggcctccagctgcctgccttcagcaagatcgggggcatcttggccaatgagctctcggtggatgaggctgcagtccatgcagctgttcttgccatcaatgaagcagtggagcgaggggtggtggaggacaccctggctgccttgcagaatcccagtgctcttctggagaatctccgagagcctctggcagccgtctaccaagagatgctggcccaggccaagatggagaaggcagccaatgccaggaaccatgatgacagagaaagccaggacatctatgaccactacctaactcaggctgaaatccagggcaatatcaaccatgtcaacgtccatggggctctagaagttgttgatgatgccctggaaagacagagccctgaagccttgctcaaggcccttcaagaccctgccctggccctgcgaggggtgaggagagactttgctgactggtacctggagcagctgaactcagacagagagcagaaggcacaggagctgggcctggtggagcttctggaaaaggaggaagtccaggctggtgtggctgcagccaacacaaagggtgatcaggaacaagccatgctccacgctgtgcagcggatcaacaaagccatccggaggagagtggcggctgacactgtgaaggagctgatgtgccctgaggcccagctgcctccagtgtaccctgttgcatcgtctatgtaccagctggagctggcagtgctccagcagcagcagggggagcttggccaggaggagctcttcgtggctgtggagatgctctcagctgtggtcctgattaaccgggccctggaggcccgggatgccagtggcttctggagcagcctggtgaaccctgccacaggcctggctgaggtggaaggagaaaatgcccagcgttacttcgatgccctgctgaaattgcgacaggagcgtgggatgggtgaggacttcctgagctggaatgacctgcaggccaccgtgagccaggtcaatgcacagacccaggaagagactgaccgggtccttgcagtcagcctcatcaatgaggctctggacaaaggcagccctgagaagactctgtctgccctactgcttcctgcagctggcctagatgatgtcagcctccctgtcgcccctcggtaccatctcctccttgtggcagccaaaaggcagaaggcccaggtgacaggggatcctggagctgtgctgtggcttgaggagatccgccagggagtggtcagagccaaccaggacactaatacagctcagagaatggctcttggtgtggctgccatcaatcaagccatcaaggagggcaaggcagcccagactgagcgggtgttgaggaaccccgcagtggcccttcgaggggtagttcccgactgtgccaacggctaccagcgagccctggaaagtgccatggcaaagaaacagcgtccagcagacacagctttctgggttcaacatgacatgaaggatggcactgcctactacttccatctgcagaccttccaggggatctgggagcaacctcctggctgccccctcaacacctctcacctgacccgggaggagatccagtcagctgtcaccaaggtcactgctgcctatgaccgccaacagctctggaaagccaacgtcggctttgttatccagctccaggcccgcctccgtggcttcctagttcggcagaagtttgctgagcattcccactttctgaggacctggctcccagcagtcatcaagatccaggctcattggcggggttataggcagcggaagatttacctggagtggttgcagtattttaaagcaaacctggatgccataatcaagatccaggcctgggcccggatgtgggcagctcggaggcaatacctgaggcgtctgcactacttccagaagaatgttaactccattgtgaagatccaggcatttttccgagccaggaaagcccaagatgactacaggatattagtgcatgcaccccaccctcctctcagtgtggtacgcagatttgcccatctcttgaatcaaagccagcaagacttcttggctgaggcagagctgctgaagctccaggaagaggtagttaggaagatccgatccaatcagcagctggagcaggacctcaacatcatggacatcaagattggcctgctggtgaagaaccggatcactctgcaggaagtggtctcccactgcaagaagctgaccaagaggaataaggaacagctgtcagatatgatggttctggacaagcagaagggtttaaagtcgctgagcaaagagaaacggcagaaactagaagcataccaacacctcttctacctgctccagactcagcccatctacctggccaagctgatctttcagatgccacagaacaaaaccaccaagttcatggaggcagtgattttcagcctgtacaactatgcctccagccgccgagaggcctatctcctgctccagctgttcaagacagcactccaggaggaaatcaagtcaaaggtggagcagccccaggacgtggtgacaggcaacccaacagtggtgaggctggtggtgagattctaccgtaatgggcggggacagagtgccctgcaggagattctgggcaaggttatccaggatgtgctagaagacaaagtgctcagcgtccacacagaccctgtccacctctataagaactggatcaaccagactgaggcccagacagggcagcgcagccatctcccatatgatgtcaccccggagcaggccttgagccaccccgaggtccagagacgactggacatcgccctacgcaacctcctcgccatgactgataagttccttttagccatcacctcatctgtggaccaaattccgtatgggatgcgatatgtggccaaagtcctgaaggcaactctggcagagaaattccctgacgccacagacagcgaggtctataaggtggtcgggaacctcctgtactaccgcttcctgaacccagctgtggtggctcctgacgccttcgacattgtggccatggcagctggtggagccctggctgccccccagcgccatgccctgggggctgtggctcagctcctacagcacgctgcggctggcaaggccttctctgggcagagccagcacctacgggtcctgaatgactatctggaggaaacacacctcaagttcaggaagttcatccatagagcctgccaggtgccagagccagaggagcgttttgcagtggacgagtactcagacatggtggctgtggccaaacccatggtgtacatcaccgtgggggagctggtcaacacgcacaggctgttgctggagcaccaggactgcattgcccctgatcaccaagaccccctgcatgagctcctggaggatcttggggagctgcccaccatccctgaccttattggtgagagcatcgctgcagatgggcacacggacctgagcaagctagaagtgtccctgacgctgaccaacaagtttgaaggactagaggcagatgctgatgactccaacacccgtagcctgcttctgagcaccaagcagctgttggccgatatcatacagttccatcctggggacaccctcaaggagatcctgtccctctcggcttccagagagcaagaagcagcccacaagcagctgatgagccgacgccaggcctgtacagcccagacaccggagccactgcgacgacaccgctcactgacagctcactccctcctgccactggcagagaagcagcggcgcgtcctgcggaacctacgccgacttgaagccctggggttggtcagcgccagaaatggctaccaggggctagtggacgagctggccaaggacatccgcaaccagcacagacacaggcacaggcggaaggcagagctggtgaagctgcaggccacattacagggcctgagcactaagaccaccttctatgaggagcagggtgactactacagccagtacatccgggcctgcctggaccacctggcccccgactccaagagttctgggaaggggaagaagcagccttctcttcattacactgctgctcagctcctggaaaagggtgtcttggtggaaattgaagatcttcccgcctctcacttcagaaacgtcatctttgacatcacgccgggagatgaggcaggaaagtttgaagtaaatgccaagttcctgggtgtggacatggagcgatttcagcttcactatcaggatctcctgcagctccagtatgagggtgtggctgtcatgaaactcttcaacaaggccaaagtcaatgtcaaccttctcatcttcctcctcaacaagaagtttttgcggaagtgacagaggcaaagggtgctacccaagcccctcttacctctctggatgctttctttaacactaactcaccactgtgcttccctgcagacacctagagctcaggactgggcaaggcccagggattctcaccccttccccagctgggaggagcttgcctgcctggccacagacagtgtatcttctaattggctaaagtgggccttgcccagagtccagctgtgtggcttttatcatgcatgacaaacccctggctttcctgccagatggtaggacatggaccttgacctgggaaagccattactcttgtgtctgctactgccctcccacagtcaccccaatattacaagcactgccccagcggcttgatttcccctctgccttccttctctctgcactcccacaaagccagggccaggctccccatccctacctcccactgcatcagcagtgggtgttcctgcccttcctgagtctaggcagctctgctgctgtgatctgcacaccctccaacctgggcagggactggggggatgcagtgtgtgttagtgcccatgtggcattgtggcactgttgccccccatggcggcatgggcaagatgaccttccattagcttcaagtcttgttctcttgtctgtggtctgtttaatatgtgggtcactagggtatttattctttctcccatccttacactctggatcattgtgcagacttaatcagggttttaacgctttcatttttttttttttttttttttttttgagctcaaagagagttctcattttccctattcaaactaatacccatgccgtgttttttaccttggatttaaagtcaccttaggttggggcaacagattctcactcatgtttaagatcttgttatttcagcttcataagatcaaagaggagtctttcccttttctcttttaccctcaggattctcatcccttacagctgactcttccaggcaatttccatagatctgcagtcctgcctctgccacagtctctctgttgtccccacatctacccaacttcctgtactgttgcccttctgatgttaataaaagcagctgttactccca

SEQ ID NO: 2911 - DNA, 2626 bp, Homo sapiens
cgaggccccgggtgagaaacgggggagacgcgaggggcggagcttgtggaggaagatggctgccgcctgggggtcgtccctaacggccgcgacgcagagagcggtcactccctggccgaggggcaggctcctcacggcctccctgggaccccaggcgcgtcgggaggcgtcgtcctccagccccgaggccggcgaagggcagatccgcctcacagacagttgcgtccagaggcttttggaaatcaccgaagggtcagaattcctcaggctgcaagtggagggaggtggatgctccggattccaatacaaattttcactggatacagttatcaaccccgacgacagggtatttgaacagggtggggcaagagtggtggttgactctgatagcttggccttcgtgaaaggggcccaggtggacttcagccaagaactgatccgaagctcatttcaagtgttgaacaatcctcaagcacagcaaggctgctcctgtgggtcatctttctctatcaaactttgatgtgatgactggtgactctgggattgtcaccagttgtaccaatttgaagaacctggaattagtagaattctagaagtttacttctaatcatgtccctctcaattttatttcccgcagtccaggagtgttatgttttgccactattattttcagaatgtgaagattttactcttggcttaatttttccctccactcagtgctaaggctgagcctccagatgctgttacctcagatttaatcactggttgaaactccgtataatctgtagagcctccatggctctaaaatttggaattaacttctcttgccttaagagctgcttgtacatatgtggatagctatgtataaaagcttcattttaaagaaggttcttattgtgttgtggatcagggtcacagattgggtagcttggacaccagttattagaggatgagaaaagtaaatgaaatgttctctttttcacttcaccctgccagaatgtgccacttgacttatctttattgtctatgcaacccatttgccacttcctgtttgataggacagatacattttactctcatgctcgtggatctgctatgagtcataaaaccaagagcccgttacccagaaaacttggaccaaaccctcactgatagtgaattatttcaaaaatagcctccctactcatacagacattttaagattctgtgacaatttaatgactgaatctttttaggatatgttgctttacctgccttctgttgtaaaatggctctggtctcatgcacagcaggaagtgatccctttattgttataggtaatagattcttgggaacctttttttagattgggttaccagatgaaatgtaggatgcccagttaaatttgaatttcaggtaaataattttttagtatgcatatgtctcaaatattgcatatactaaaaattactatttgaaattcaaatttaactcatatttttatttgctgaccttggcaactctgctttagggtcaccaaacagcttttaaaatcacaaattctagtgaattaaagtacttgtgtaggtgtggcacttaaataggcttcggagcttgaaataatcctgttagagtactgtggagctgtgtggacagacagtgaaagaaatctaccaccatcaccacaccgaatgatttattaatactgatgttggagaaactacaaccaagttgattctggaagagttactggttaaatccatcttttgcttgggagcctagaagtttgttacagtaaagacttgcatttctgcactggattggaattaaggtcatttagtaagaatttactatttaaaaaaatggaaatagagtttagaaaatatctgagacagaaacttagatacatttccaacatggcaaaacctaggacttagagaaaacaaacctatcatgcggttagaggagagaaggggacactcagaaacctgagcacatttcttagagctggtggaaggaggcagaaagcagcataccatgggagcatctgtgtgcacacatgaccaagacagtgccgccagtacctgcgcctgatagggtttcagttcagactacctgtcctttcatcctccttaaaaagattttgctacattttaaacattagaatatattctttaagaatatttttgtgggttatttattgattttgtggttttaaaactcttgagcacgagcagaacagcttttgttgctaaatcaatcaaattacagtggtgcactagacagaaacagtcccttagaatgcagcttatatgtgagtatctactgttaatgggagaattggaattttatgtttagaaaaaggcagatttggggctgggcacggtggctcacgcctgtgatcccagcactttgggaggccaaagcaggcagatcacctgaggtcaggagtttgagaccagcctgggcaacatggtgaaaccccatctctactaaaaatacaaaaattaactgcgtggtggacacctgtaatcccagctactcgggagactgaggcaagagaatcacttgaacccaggaggtggagattgcagtgagccaagattgcaccactggactccagcctgggtggcagagtgagactctg

SEQ ID NO: 2912 - DNA, 728 bp, Homo sapiens
catgcctctggctttgacccttctgctgctctcgggcttgggcgcccccggaggctggggctgcctgcagtgcgaccccttggtgctggaggccctgggtcacctgcgctccgccctcatccccagtcgcttccagttggagcagctgcaggcgcgcgccggggccgtgctgatgggcatggaggggcctttcttccgggactacgcgctgaacgtgtttgtggggaaagtggagacaaatcaactggaccttgtggcgtcctttgtcaagaaccaaacgcagcacttaatgggtaactctctgaaagatgagcctctgctggaagagctggtgaccctcagggcgaatgtgatcaaggaattcaagaaagttttaatttcatatgaattaaaagcctgcaaccccaaactttgccgcttgctaaaagaagaggtgttggactgtttacattgccagaggatcactcccaagtgtatccacaaaaagtactgctttgtcgaccggcaaccccgcgtggccctgcagtaccagatggacagcaaatacccgaggaaccaggcgctgttgggcatcctcatttctgtgtctctggctgtctttgtcttcgtggtcatcgtggtctcggcttgtacatacagacaaaaccgaaaactcctgctgcagtaggacggtggtttgggggtaaggagaaaggaaaataaatttaataaaattggtgacaaatcca

SEQ ID NO: 2913 - DNA, 707 bp, Homo sapiens
gtgatgctccctgggcctcctgaccgcgccctcgcctgggaggcggggcgggccgggttctctctgtgacgtcacaaaggccccgccatgcctctggctttgacccttctgctgctctcgggcttgggcgcccccggaggctggggctgcctgcagtgcgaccccttggtgctggaggccctgggtcacctgcgctccgccctcatccccagtcgcttccagttggagcagctgcaggcgcgcgccggggccgtgctgatgggcatggaggggcctttcttccgggactacgcgctgaacgtgtttgtggggaaagtggagacaaatcaactggaccttgtggcgtcctttgtcaagaaccaaacgcagcacttaatgggtaactctctgaaagatgagcctctgctggaagagctggtgaccctcagggcgaatgtgatcaaggaattcaagaaagttttaatttcatatgaattaaaagccggcaaccccgcgtggccctgcagtaccagatggacagcaaatacccgaggaaccaggcgctgttgggcatcctcatttctgtgtctctggctgtctttgtcttcgtggtcatcgtggtctcggcttgtacatacagacaaaaccgaaaactcctgctgcagtaggacggtggtttgggggtaaggagaaaggaaaataaatttaataaaattggtgacaaatcc

SEQ ID NO: 2914 - DNA, 720 bp, Homo sapiens
atgggtgacctgtggttattcctgctcctgcccctctcagccttccatggagtcaaaggctgtttagaatgtgaccccaaatttatagaggatgttggctccttgctgggaaatctgataccttcagaagtccccggccgaactcagctgcttgaacggcagattaaggagatgattcatttaagcttcaaggtctcccacagtgacaagaggcttcgggtgttggctgttcagcaggttgttaagttgagaacatggttgaagaatgaattttataaactgggcaatgaaacatggaaaggtgtctttatctatcaaggcaagcttctcgatgtctgccaaaacctggaatccaaactgaaagaattactaaagaacttctctgaaattgcttgttctgaagattgcattgtggttgaaggtcccattcttgattgttggacgtgtcttcgcatgactaacaggtgcttcaaaggagaatattgtggagacgaggatccaagaaaggctgagaatcgagagattgctctatttctcatattgctggcaacagctgtaatactgggaagtgctgtgttactattccatttttgcatctttcatcggaggaaaatgaaggcaatacgaaggtcgctaaaggaatatgtggagaagaaacttgaagaattaatggggaagatagatgagaaggaggagaaagactttagactcagaaaataa

SEQ ID NO: 2915 - DNA, 1621 bp, Homo sapiens
ggaatatctataaaggaattcgggcccctacgtgagaagctcggagggggtggtttcaggagttccttgtggagaggggatcgtccgtgactcagaccccgtcgaaaagctctcgatttcacgcaaccaaccttaccctcgtccccaacacaatccttgattttacccctgggaaaattagcgtaggtggtcatgaccccggcttcctctttaaaagccctcagaacctggaccgggctcctcaatgaaccctagtgttagaggccacaaatcgggaaccaaggtcggggagcggctgtttagggtgcatcactgttcaggatgcatcggggctcctttttctaagcggaagggtgcgccctgcaaattgggagcccgttagttttggggaagggtgaacaagggccccctaggtctagaggaccgcatggagtctcgcttaagtgttagtggggtcctcagttctaggaatctgcgttctcctgctctcggtttggggtgagagcacccttcctaacggtcttcgggaactgtgcgcgccggctgcaatggggccgcattttaccctcctgtgtgcggcgctggccggttgcttgcttcctgccgaggggtgtgttatatgtgacccgtctgtcgtgctggcgctaaagtccctggagaaagattacctgcctggccacctggatgcgaagcatcacaaagccatgatggaaagggtagagaatgccgtgaaggatttccaggaactgtcgcttaatgaggatgcctatatgggggtcgttgatgaggccacactgcaaaaggggtcctggagtttgctgaaggatctgaaacgcatcacagacagtgatgtaaaaggcgatctcttcgtgaaggagctattttggatgttgcacttgcaaaaggaaacctttgccacctatgttgctcgattccaaaaagaggcttattgtcccaacaaatgtggtgtgatgttgcaaactctgatctggtgcaagaactgcaaaaaggaggttcacgcttgtcgaaagtcctacgattgcggggagcggaatgtggaagttcctcaaatggaagacatgatcctggactgtgagttaaactggcatcaggcttcggaaggcctcactgattacagcttttacagggtttgggggaacaatacggagaccttggtgtccaaggggaaagaggccaccctgaccaagcccatggtgggtccagaggatgcaggcagctaccgctgcgagctgggctctgtgaattccagcccagccacgatcatcaattttcacgtcacagtgttgcccaaaatgatcaaggaggaaaaaccttctccaaatatcgtaaccccgggggaggcgaccacggagtcgtccataagcctccagcctctgcagcccgagaaaatgctggcaagccgccttctggggctgctgatctgcggctccctagcactgataaccggccttacctttgcgatatttcgtcgaaggaaggtgatcgatttcatcaaatcctcactgtttggccttggcagtggagcggccgagcaaacccaggtcccaaaagaaaaggccacagattcgaggcaacaataaagatttatcttgttgtctaa

SEQ ID NO: 2916 - DNA, 1693 bp, Homo sapiens
gcgcggagaggagtgaccatagagtcggtcctccagagacagaggggccggaagttctcttcacggagccgcgcggctgcgggggcgcaaatagggtcagtgggccgcttggcggtgtcgttgcggtaccaggtccgcgtgaggggttcgggggttctgggcaggcacaatggcgtctcgagcaggcccgcgagcggccggcaccgacggcagcgactttcagcaccgggagcgcgtcgccatgcactaccagatgagtgtgactctcaagtatgaaatcaagaagctgatctacgtacatctggtcatatggctgctgctggttgctaagatgagcgtgggacacctgaggctcttgtcacatgatcaggtggccatgccctatcagtgggaatacccgtatttgctgagcattttgccctctctcttgggccttctctcctttccccgcaacaacattagctacctggtgctctccatgatcagcatgggactcttttccatcgctccactcatttatggcagcatggagatgttccctgctgcacagcagctctaccgccatggcaaggcctaccgtttcctctttggtttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccaggccaaagttctggaaagctccttttgccatctgctgaggtggcaaaactataatttattcctggttggctagaactgggtgaccaacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcaggctgtggtctcctctgcaaagcattttaattaaaaacctcaataaagatggccctgcccacactgtgccttgtgtttggggcttgatagagtgtgaaaggtgtgttgcttgaaaggtgtggccttagacactaggagatgatgggtagaagctccttgagaaacctagcagtggccatagagaagtagactgggtatggggaacctaagtcatagttgtaacctacagctgattggtaagaactatgggccagacatttaatctctccatctatgaaatagtccattctcatttatctaccttaggttatgggctcttcttttagttggatattcacatttatctttcagtgttaactgggtatcagttatgagtctactactgtataatggcatccaaaagaattttaaagtacctcggtttatagggatttacaattcagtagaaacttgttattcatgtgaaacagtgaacataatatctaatgatgtggagcaagtacattaaaaacaggaaggaagagatctgtgattaaactaaaggccctttcacacctaaaa

SEQ ID NO: 2917 - DNA, 1133 bp, Homo sapiens
gttctcttcacggagccgcgcggctgcgggggcgcaaatagggtcagtgggccgcttggcggtgtcgttgcggtaccaggtccgcgtgaggggttcgggggttctgggcaggcacaatggcgtctcgagcaggcccgcgagcggccggcaccgacggcagcgactttcagcaccgggagcgcgtcgccatgcactaccagatgagtgtgactctcaagtatgaaatcaagaagctgatctacgtacatctggtcatatggctgctgctggttgctaagatgagcgtgggacacctgaggctcttgtcacatgatcaggtggccatgccctatcagtgggaatacccgtatttgctgagcattttgccctctctcttgggccttctctcctttccccgcaacaacattagctacctggtgctctccatgatcagcatgggactctttcatcgctccactcatttatggcagcatggagatgttccctgctgcacagcagctaccgccatggcaaggcctaccgtttcctctttggtttttctgccgtttccaatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccaggccaaagttctggaaagctccttttgccatctgctgaggtggcaaaactataatttattcctggttggctagaactgggtgaccaacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcaggctgtggtctcctctgcaaagcattttaattaaaaacctcaataaagatggccctgccc

SEQ ID NO: 2918 - DNA, 2585 bp, Homo sapiens
ggtgccgtgcctgagccgggcgcgggcgaccgagggagctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaaggtgggcaaactgcgcgagcggctgcaggaggcgaagctggagcgcgagcaggagcagcgacggcacacggcctacatttcggagctcaaggccaagctgcatgaggagaagaccaaggagctgcaggcgctgcgcgaggggctcatccggcagcacgagcaggaggcggcgcgcaccgccaagatcaaggagggcgagctgcagcggctgcaggccacgctgaacgtgctgcgcgacggcgcggccgacaaggtcaagacggcgctgctgaccgaggcgcgcgaggaggcgcgcagggccttcgatggagagcgcctgcggctgcagcaggagatcctggagctcaaggcagcgcgcaagcaggcagaggaggcgctcagtaactgcatgcaggctgacaagaccaaggcagccgacctgcgtgccgcctaccaggcgcaccaagacgaggtgcaccgcatcaagcgcgagtgcgagcgcgacatccgcaggctgatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggagtaccaggccctgcaacgcgcctacgccctgctccaggagcaggtgggaggcacgctggacgctgagagggaggcccggactcgggagcagctacaagctgatctgctgaggtgtcaggccaaaatcgaagatttggagaagttactggttgagaagggacaggattccaagtgggttgaagagaagcagctgctcatcagaacaaaccaagacttgctggaaaagatttacagactggaaatggaagagaaccagctgaagaatgaaatgcaagacgccaaggatcagaacgagctgttagaattcagagtgctagaactcgaagtaagagactctatctgttgtaaactctcaaacggagcagacattctctttgaacccaaactgaaattcatgtaaagctctcagatgttttcaagcatgtgtaaaggggacatgttatagtttctttctttctttctttctttttttttttaaatctgtatgttcagaataatttcactgccttaatgtgttctggagagcgtgctcacccaagtctatggacatgtaccagagctaatatatttattgcctatggcttgttttgcacttaataaaataatttgtttttgcaa

SEQ ID NO: 2919 - DNA, 2975 bp, Homo sapiens
agctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaaggtgggcaaactgcgcgagcggctgcaggaggcgaagctggagcgcgagcaggagcagcgacggcacacggcctacatttcggagctcaaggccaagctgcatgaggagaagaccaaggagctgcaggcgctgcgcgaggggctcatccggcagcacgagcaggaggcggcgcgcaccgccaagatcaaggagggcgagctgcagcggctgcaggccacgctgaacgtgctgcgcgacggcgcggccgacaaggtcaagacggcgctgctgaccgaggcgcgcgaggaggcgcgcagggccttcgatggagagcgcctgcggctgcagcaggagatcctggagctcaaggcagcgcgcaagcaggcagaggaggcgctcagtaactgcatgcaggctgacaagaccaaggcagccgacctgcgtgccgcctaccaggcgcaccaagacgaggtgcaccgcatcaagcgcgagtgcgagcgcgacatccgcaggctgatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggagtaccaggccctgcaacgcgcctacgccctgctccaggagcaggtgggaggcacgctggacgctgagagggaggcccggactcgggagcagctacaagctgatctgctgaggtgtcaggccaaaatcgaagatttggagaagttactggttgagaagggacaggattccaagtgggttgaagagaagcagctgctcatcagaacaaaccaagacttgctggaaaagatttacagactggaaatggaagagaaccagctgaagaatgaaatgcaagacgccaaggatcagaacgagctgttagaattcagagtgctagaactcgaagagagagagaggaggtcgccagcatttaacctccaaatcaccaccttccccgagaaccacagcagcgctctccagctgttctgtcaccaggaaggagttaaggatgtgaatgtttctgaacttatgaagaaattagatatccttggcgataacgggaatttgagaaatgaagaacaggttgcaataatccaagctggaactgtgcttgccctgtgtgaaaagtggctgaagcaaatagaggggaccgaggccgccctgacccagaagatgctggacctggagaaggagaaggacctgttcagcaggcagaagggctacctggaagaggagctcgactaccggaagcaagcccttgaccaggcttacctgaaaatccaagacctggaggccacactgtacacagcgctgcagcaggagccggggcggagggccggtgaggcgctgagcgagggccagcgggaggacctgcaggctgctgtggaaaaggtgcgcaggcagatcctcaggcagagccgcgagttcgacagccagatcctgcgggagcgcatggagctgctgcagcaggcccagcagagaatccgagaactggaggacaaactggagtttcagaagcggcacctgaaagaactggaggaaaagtttttgttcctttttttgtttttctcactagcattcattctgtggccttgatgacttcagtgagccaagaactcgggttg

SEQ ID NO: 2920 - DNA, 2420 bp, Homo sapiens
agctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaagatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactgaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggagtaccaggccctgcaacgcgcctacgccctgctccaggagcaggtgggaggcacgctggacgctgagagggaggcccggactcgggagcagctacaagctgatctgctgaggtgtcaggccaaaatcgaagatttggagaagttactggttgagaagggacaggattccaagtgggttgaagagaagcagctgctcatcagaacaaaccaagacttgctggaaaagatttacagactggaaatggaagagaaccagctgaagaatgaaatgcaagacgccaaggatcagaacgagctgttagaattcagagtgctagaactcgaagagagagagaggaggtcgccagcatttaacctccaaatcaccaccttccccgagaaccacagcagcgctctccagctgttctgtcaccaggaaggagttaaggatgtgaatgtttctgaacttatgaagaaattagatatccttggcgataacgggaatttgagaaatgaagaacaggttgcaataatccaagctggaactgtgcttgccctgtgtgaaaagtggctgaagcaaatagaggggaccgaggccgccctgacccagaagatgctggacctggagaaggagaaggacctgttcagcaggcagaagggctacctggaagaggagctcgactaccggaagcaagcccttgaccaggcttacctgaaaatccaagacctggaggccacactgtacacagcgctgcagcaggagccggggcggagggccggtgaggcgctgagcgagggccagcgggaggacctgcaggctgctgtggaaaaggtgcgcaggcagatcctcaggcagagccgcgagttcgacagccagatcctgcgggagcgcatggagctgctgcagcaggcccagcagagaatccgagaactggaggacaaactggagtttcagaagcggcacctgaaagaactggaggaaaagtttttgttcctttttttgtttttctcactagcattcattctgtggccttgatgacttcagtgagccaagaactcgggttg

SEQ ID NO: 2921 - DNA, 2371 bp, Homo sapiens
attttgagtcaggagcctggactgacccgggtccctccacagcactggagggggtgggacacatcactacagggtttccttccatgaggactctgaggagttgacagtggaggcaaggagtgagctggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaaggtgggcaaactgcgcgagcggctgcaggaggcgaagctggagcgcgagcaggagcagcgacggcacacggcctacatttcggagctcaaggccaagctgcatgaggagaagaccaaggagctgcaggcgctgcgcgaggggctcatccggcagcacgagcaggaggcggcgcgcaccgccaagatcaaggagggcgagctgcagcggctgcaggccacgctgaacgtgctgcgcgacggcgcggccgacaaggtcaagacggcgctgctgaccgaggcgcgcgaggaggcgcgcagggccttcgatggagagcgcctgcggctgcagcaggagatcctggagctcaaggcagcgcgcaagcaggcagaggaggcgctcagtaactgcatgcaggctgacaagaccaaggcagccgacctgcgtgccgcctaccaggcgcaccaagacgaggtgcaccgcatcaagcgcgagtgcgagcgcgacatccgcaggctgatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggagtaccaggccctgcaacgcgcctacgccctgctccaggagcaggtgggaggcacgctggacgctgagagggaggcccggactcgggagcagctacaagctgatctgctgaggtgtcaggccaaaatcgaagatttggagaagttactggttgagaagggacaggattccaagtgggttgaagagaagcagctgctcatcagaacaaaccaagacttgctggaaaagatttacagactggaaatggaagagaaccagctgaagaatgaaatgcaagacgccaaggatcagaacgagctgttagaattcagagtgctagaactcgaagtaagagactctatctgttgtaaactctcaaacggagcagacattctctttgaacccaaactgaaattcatgtaaagctctcagatgttttcaagcatgtgtaaaggggacatgttatagtttctttctttctttctttctttttttttttaaatctgtatgttcagaataatttcactgccttaatgtgttctggagagcgtgctcacccaagtctatggacatgtaccagagctaatatatttattgcctatggcttgttttgcacttaataaaataatttgtttttgc

SEQ ID NO: 2922 - DNA, 1779 bp, Homo sapiens
ggtgccgtgcctgagccgggcgcgggcgaccgagggagctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaaggtgggcaaactgcgcgagcggctgcaggaggcgaagctggagcgcgagcaggagcagcgacggcacacggcctacatttcggagctcaaggccaagctgcatgaggagaagaccaaggagctgcaggcgctgcgcgaggggctcatccggcagcacgagcaggaggcggcgcgcaccgccaagatcaaggagggcgagctgcagcggctgcaggccacgctgaacgtgctgcgcgacggcgcggccgacaaggtcaagacggcgctgctgaccgaggcgcgcgaggaggcgcgcagggccttcgatggagagcgcctgcggctgcagcaggagatcctggagctcaaggcagcgcgcaagcaggcagaggaggcgctcagtaactgcatgcaggctgacaagaccaaggcagccgacctgcgtgccgcctaccaggcgcaccaagacgaggtgcaccgcatcaagcgcgagtgcgagcgcgacatccgcaggctgatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgccagatcctgcgggagcgcatggagctgctgcagcaggcccagcagagaatccgagaactggaggacaaactggagtttcagaagcggcacctgaaagaactggaggaaaagtttttgttcctttttttgtttttctcactagcattcattctgtggccttgatgacttcagtgagccaagaactcgggttg

SEQ ID NO: 2923 - DNA, 2225 bp, Homo sapiens
ggtgccgtgcctgagccgggcgcgggcgaccgagggagctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaaggtgggcaaactgcgcgagcggctgcaggaggcgaagctggagcgcgagcaggagcagcgacggcacacggcctacatttcggagctcaaggccaagctgcatgaggagaagaccaaggagctgcaggcgctgcgcgaggggctcatccggcagcacgagcaggaggcggcgcgcaccgccaagatcaaggagggcgagctgcagcggctgcaggccacgctgaacgtgctgcgcgacggcgcggccgacaaggtcaagacggcgctgctgaccgaggcgcgcgaggaggcgcgcagggccttcgatggagagcgcctgcggctgcagcaggagatcctggagctcaaggcagcgcgcaagcaggcagaggaggcgctcagtaactgcatgcaggctgacaagaccaaggcagccgacctgcgtgccgcctaccaggcgcaccaagacgaggtgcaccgcatcaagcgcgagtgcgagcgcgacatccgcaggctgatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggaggacctgcaggctgctgtggaaaaggtgcgcaggcagatcctcaggcagagccgcgagttcgacagccagatcctgcgggagcgcatggagctgctgcagcaggcccagcagagaatccgagaactggaggacaaactggagtttcagaagcggcacctgaaagaactggaggaaaagtttttgttcctttttttgtttttctcactagcattcattctgtggccttgatgacttcagtgagccaagaactcgggttg

SEQ ID NO: 2924 - DNA, 2202 bp, Homo sapiens
cgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggcgctgcgcgaggggctcatccggcagcacgagcaggaggcggcgcgcaccgccaagatcaaggagatcctggagctcaaggcagcgcgcaagcaggcagaggaggcgctcagtaactgcatgcaggctgacaagaccaaggcagccgacctgcgtgccgcctaccaggcgcaccaagacgaggtgcaccgcatcaagcgcgagtgcgagcgcgacatccgcaggctgatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggagtaccaggccctgcaacgcgcctacgccctgctccaggagcaggtgggaggcacgctggacgctgagagggaggcccggactcgggagcagctacaagctgatctgctgaggtgtcaggccaaaatcgaagatttggagaagttactggttgagaagggacaggattccaagtgggttgaagagaagcagctgctcatcagaacaaaccaagacttgctggaaaagatttacagactggaaatggaagagaaccagctgaagaatgaaatgcaagacgccaaggatcagaacgagctgttagaattcagagtgctagaactcgaagtaagagactctatctgttgtaaactctcaaacggagcagacattctctttgaacccaaactgaaattcatgtaaagctctcagatgttttcaagcatgtgtaaaggggacatgttatagtttctttctttctttctttctttttttttttaaatctgtatgttcagaataatttcactgccttaatgtgttctggagagcgtgctcacccaagtctatggacatgtaccagagctaatatatttattgcctatggcttgttttgcacttaataaaataatttgtttttgcaat

SEQ ID NO: 2925 - DNA, 6001 bp, Homo sapiens
gaggaggagccagaggaggtgtctgctgcaagttcctggctgcttccgagctcaccccatcctccgagagggaggaggcccaactggtgatgctgctgctgctgctgctgccgccgccgccgcctctattgctgatactctagtggggctggaagggtggttcctattcgcaccatcgccaaccagagacagagggaaaaaaaaaaccggcagccactgctgatgttgggttcggaggctgcatccgactcggtcacaaggaaaatggattcagtttgcatctctccctcctttaaacagcttctccgggtctcagcatgggcttccagggcagcgattgaggagaccttaccaaggagcaccacacagtagatgctgagacatcgtactccaggataagaaacagtaacatggcagcacctgcttgaaagaaattaaaaaccaacagactccatttagaaaggaacaatgtccaagaaagggcgaaataagggcgagaagcccgaggcactcattgttgcccttcaagctgccaatgaagacctcaggaccaagctcacagacattcagatagagctgcatcaagagaagtccaaggtatcaaagcttgaaagagagaagactcaagaagcgaagaggattcgtgagctggagcagcgcaagcacacggtgctggtgacagaactcaaagccaagctccatgaggagaagatgaaggagctgcaggctgtgagggagaaccttatcaagcagcacgagcaggaaatgtcaaggacggtgaaggtacgtgatggagagatccagaggctcaagtctgctctctgtgctctccgcgacggcagcagtgacaaagtaaggacagcgctcaccattgaggcccgggaggaggcccggaaactgtttgacacagagcgccttaagctcttacaggaaattgcggacctgaaaacggccaagaagcaggtggacgaggctctgagcaatatgatccaagcagataaaatcaaggctggggaccttcggagtgagcatcagtcccaccaagaagccatctcgaagatcaagtgggagtcggagcgggatattcggaggctgatggatgaaatcaaagccaaggacaggatcatcttttccctggaaaaggaactggagacccagacaggctatgtacagaaactccaacttcagaaggaggctttggacgaacaactctttctggtcaaggaggctgagtgcaacatgagcagcccaaaacgagaaattccaggaagggcaggtgatggttccgaacactgcagcagtcctgatttgcgaagaaatcaaaagagaatagctgaattgaatgccactataagaaaattagaagacaggaataccttgcttggagatgaacgaaatgaactgttaaaacgtgtgcgggaaaccgaaaagcaatgtaaacctctcctggaaaggaacaagtgcctcgccaagagaaacgatgaactgatggtgtccttgcagcgcatggaagaaaaactaaaagccgttaccaaggaaaattcagaaatgagagaaaaaataacatcccatccacccctgaagaaattaaaatctctgaatgacctcgaccaagctaatgaagaacaagaaacagagtttctaaaacttcaggtcattgagcaacagaacattattgatgagctcacaagggaccgagaaaagctcatccgtagaagaaagcatagaagaagttccaagccaattaagaggcctgttttggacccgtttattggctatgatgaggactctatggattcagagacatcatccatggcctcatttagaacagacagaacaccagctactcctgatgatgacttggatgaaagtttagcagctgaagaatctgaactaagatttcgacaattaacaaaagaatatcaggccctccaaagagcatatgccctcctacaggagcagacgggaggcatcatcgacgctgaacgagaagccaaggctcaagaacagctccaagcagaggtgctaaggtataaagccaaaattgaagacctggaagcgactctggctcagaaagggcaggattcacactgggtagaagataaacaacttttcattaagagaaaccaggagcttttagaaaagatagaaaaacaggaggcagaaaatcaccggttacaacaagaactacaggacgccagagaccagaatgagctgctggagtttcgaaacctagagctagaagagagagagagacgatcccctccatttaatctccaaattcacccattctcagatggtgtgagtgctctacagatctactgtatgaaagaaggtgttaaggatgtgaacatccctgatctcataaagcagcttgatatcttgggtgataatgggaatttaagaaatgaagaacaagtggccataattcaggccagcactgtgctgtccctggcagagaagtggatccagcagattgaaggagctgaggctgccctacaccagaaaatgatggaattggaaagtgacatggaacagttctgcaaaataaaaggctatctggaggaagaactagactacagaaaacaagctcttgaccaagcatatatgagaatccaggaactagaagctactttgtacaatgctctacagcaagaaactgttatcaagtttggtgaattattaagtgaaaaacagcaagaggagctgaggacggcagtagaaaagttacggcggcaaatgctgaggaagagcagagagtatgactgtcagattcttcaggagagaatggagctcttacagcaagcccatcagagaattcgtgacttagaagataaaacagacatccagaaaagacaaataaaagacttagaagaaaagagtaaccgaaaacatggataagatcccaggaagacaagtgcttctaaaccttcaaagatggcaaaattgtttacaccagtgagagggagatcaaaagctaagaactaccctgtagccaggactacaactgtgtattttaaagccattattcaaggtttcttacttgacagttcctacacaaccctgttgaaaatctacaatatatgctgcatttaatgaaacatgtatatgtcaaatcagaagagaagaactataaacatatattgtgtaaagaaaaagttcagcaatggaactagtttctgcagatcaagcaaagatgtgtcttgggcatggaaccaaagttacaatgaaatattcaacccctgctgtgcaggggggtcattttaatgtaacaccacaccccatggaaacactagtcctgataataaacatcattttaaaagatcaaaacaaacaaacaaaaaaaacaagggtgggtggggagtgaagcacgaggaatacctatgaagagctatttacaataaaatgtttcatttgaaaagtctggtttcttactacagggatttgcttttctgtctttatgattgttttaaactcaggaacagagacatccgcatcgtaaatgggaagaaaaacactctctgttttgtttttctgcaaaaggtggagcttgtggaattcattccacagacgacagatgagaagtggatcacagtgaccacaacaaaactggtaacgaagtcaaaggacccgagcgaatgtgacatgtgaaataaaagcagattcgatgcttccttgtcctactctcacatctgcattcctctatcaacaatggactgatctcattcatattgaaaactaagaagatgatactgtaaatcacatgctccctgacttagttctgtttagaacgccaacatctatagggaacatgggccagagagcatctctgaatctttcatttccaaaatactgtttttcaaatggctgcttaaaattgcctgcaaatgaatatgctatatgatttgggcaaaaacacagcagaatcaatgagtaaatttctaccaagagtcgggtttgccacagagatgtgaatattaaactaaactattattttttaaagaatcctcacatgcctagagcattctgacctcttcttgtttagagtgataacattttttcccagacagatgacagcaacaagatagctctacttttttatatggaaataacattatgttactgacaaggtcattttctaccagagacaattagaggactggtacttttcctaagttgtgtattactgagtcttggagtcatctctgagagcaaatgtatgttcctgaaaagctaattttacacctcatttactgtagataacagaacaacctcaatttttcaaatttttgaagttttatttatggggctagaattcccatgcatagagaatatgtgtagggagccagaaactctttctatgaaatgctatacaaatctttccatatgtgggttcactatcatccttcagttttagcactggcatttgcaaagccagaacaataactgaagaatgtacaataaaaactagaatgctggggtcccactttttgttcttacatttactgctgacccaggtatctttggcccagtcacttaacctctctgtgcctcagtttcctcatctgcaaaatggggttaaaatgctttttcataaagttttatttgcaattttagaacaagaggtgcttaaagtagcacaatgtgctttgtaattattacaagtgctgtattatttgactttcttgtgttgttgacaaaaagattccctcatgtaataaaatagtgcttcagtttggttaaatttaagcactatagcactgaagcttgcttatcaagctacttgggacattattagcaataaaaattgagagattcaaaaccaggatctttaataatctataggaaatagatcatctcatgctattgaacaagatagaagagtgtgtcatttctatgataagcatctcccagctctcttgattgcatatgcatgccatcatacagaaccccacttttaccacaggagagccagtcattaaacaaaggcttggagcaaactgacagtatcacataattagcttgattatcttttattctggaggaaagccaggtggtatgccctactgggaagatacaaaacagactatcctgctgtattcttttttttttttttttttgagatggagtcttgctctgttgcccatgctggagtgcattggcacaatctcggctcatggcaagctccacctcctggattcaagtgattctcctgcctcaacctccctagtagctgggattacaggtgcacaccaccacacctggctaatttttgtatttttagtagagacagggtttcactatgctggtcaggctggtctcgaactcctgacctcaagtgatctgcctgcctcagcctcccaaagtgctaggattacaggtgtaagccactgtgcccggcctcctgctggattctttattcaactaggtaggttccagattaaatatgagccatatgctcattaggcaagaaatgtgaaagagggtgcctctacagtgttggtgacccaacactagccaacttgagtcagaaaatatggaagaggataaattactctcacatatctaagacttttccatttttcttcactttctgttgcagggcccatatgagtaaatctatattccgtctgctccaacacacaccttccttctcttaattttgctttcccacccaccaagaaatttgtaagtcaaaatttatttccatgagtaactatttctaaatgattgaaaatttttgaaaaagtggtatggtttatatacctaatctgcttatctgctataagtcatatgagaacaacagctaggatgattgtccaagcagctttagatgtgtttagggccaggcaaaaggtttgcttgttttttctttttgcttaagatctgggagattagcaaatttctcaagactatagactgaactgtaatttttaccaactcttgctcatgagcctcaaaatgaatatatccttgaataaagtataaatatttcaataga

SEQ ID NO: 2926 - DNA, 2992 bp, Homo sapiens
agccagaggaggtgtctgctgcaagttcctggctgcttccgagctcaccccatcctccgagagggaggaggcccaactggtgatgctgctgctgctgctgctgccgccgccgccgcctctattgctgatactctagtggggctggaagggtggttcctattcgcaccatcgccaaccagagacagagggaaaaaaaaaaccggcagccactgctgatgttgggttcggaggctgcatccgactcggtcacaaggaaaatggattcagtttgcatctctccctcctttaaacagcttctccgggtctcagcatggtatcaaagcttgaaagagagaagactcaagaagcgaagaggattcgtgagctggagcagcgcaagcacacggtgctggtgacagaactcaaagccaagctccatgaggagaagatgaaggagctgcaggctgtgagggagaaccttatcaagcagcacgagcaggaaatgtcaaggacggtgaaggtacgtgatggagagatccagaggctcaagtctgctctctgtgctctccgcgacggcagcagtgacaaagtaaggacagcgctcaccattgaggcccgggaggaggcccggaaactgtttgacacagagcgccttaagctcttacaggaaattgcggacctgaaaacggccaagaagcaggtggacgaggctctgagcaatatgatccaagcagataaaatcaaggctggggaccttcggagtgagcatcagtcccaccaagaagccatctcgaagatcaagtgggagtcggagcgggatattcggaggctgatggatgaaatcaaagccaaggacaggatcatcttttccctggaaaaggaactggagacccagacaggctatgtacagaaactccaacttcagaaggaggctttggacgaacaactctttctggtcaaggaggctgagtgcaacatgagcagcccaaaacgagaaattccaggaagggcaggtgatggttccgaacactgcagcagtcctgatttgcgaagaaatcaaaagagaatagctgaattgaatgccactataagaaaattagaagacaggaataccttgcttggagatgaacgaaatgaactgttaaaacgtgtgcgggaaaccgaaaagcaatgtaaacctctcctggaaaggaacaagtgcctcgccaagagaaacgatgaactgatggtgtccttgcagcgcatggaagaaaaactaaaagccgttaccaaggaaaattcagaaatgagagaaaaaataacatcccatccacccctgaagaaattaaaatctctgaatgacctcgaccaagctaatgaagaacaagaaacagagtttctaaaacttcaggtcattgagcaacagaacattattgatgagctcacaagggaccgagaaaagctcatccgtagaagaaagcatagaagaagttccaagccaattaagaggcctgttttggacccgtttattggctatgatgaggactctatggattcagagacatcatccatggcctcatttagaacagacagaacaccagctactcctgatgatgacttggatgaaagtttagcagctgaagaatctgaactaagatttcgacaattaacaaaagaatatcaggccctccaaagagcatatgccctcctacaggagcagacgggaggcatcatcgacgctgaacgagaagccaaggctcaagaacagctccaagcagaggtgctaaggtataaagccaaaattgaagacctggaagcgactctggctcagaaagggcaggattcacactgggtagaagataaacaacttttcattaagagaaaccaggagcttttagaaaagatagaaaaacaggaggcagaaaatcaccggttacaacaagaactacaggacgccagagaccagaatgagctgctggagtttcgaaacctagagctagaagagagagagagacgatcccctccatttaatctccaaattcacccattctcagatggtgtgagtgctctacagatctactgtatgaaagaaggtgttaaggatgtgaacatccctgatctcataaagcagcttgatatcttgggtgataatgggaatttaagaaatgaagaacaagtggccataattcaggccagcactgtgctgtccctggcagagaagtggatccagcagattgaaggagctgaggctgccctacaccagaaaatgatggaattggaaagtgacatggaacagttctgcaaaataaaaggctatctggaggaagaactagactacagaaaacaagctcttgaccaagcatatatgagaatccaggaactagaagctactttgtacaatgctctacagcaagaaactgttatcaagtttggtgaattattaagtgaaaaacagcaagaggagctgaggacggcagtagaaaagttacggcggcaaatgctgaggaagagcagagagtatgactgtcagattcttcaggagagaatggagctcttacagcaagcccatcagagaattcgtgacttagaagataaaacagacatccagaaaagacaaataaaagacttagaagaaaagtttctgtttctattcttgttcttctctcttgcctttattctatggccttgatgtcaaggtgcctcttaaagagtaaccgaaaacatggataagatcccaggaagacaagtgcttctaaaccttcaaagatggcaaaattgtttacaccagtgagagggagatcaaaagctaagaactaccctgtagccaggactacaactgtgtattttaaagccattattcaaggtttcttacttgacagttcctacacaaccctgttgaaaatctacaatatatgctgcatttaatgaaacatgtatatgtcaaatcagaagagaagaactataaacatatattgtgtaaagaaaaagttcagcaatggaactagtttctgcagatcaagcaaagatgtgtctt

SEQ ID NO: 2927 - DNA, 5915 bp, Homo sapiens
ggaggctgcatccgactcggtcacaaggaaaatggattcagtttgcatctctccctcctttaaacagcttctccgggtctcagcatgggcttccagggcagcgattgaggagaccttaccaaggagcaccacacagtagatgctgagacatcgtactccaggataagaaacagtaacatggcagcacctgcttgaaagaaattaaaaaccaacagactccatttagaaaggaacaatgtccaagaaagggcgaaataagggcgagaagcccgaggcactcattgttgcccttcaagctgccaatgaagacctcaggaccaagctcacagacattcagatagagctgcatcaagagaagtccaaggtatcaaagcttgaaagagagaagactcaagaagcgaagaggattcgtgagctggagcagcgcaagcacacggtgctggtgacagaactcaaagccaagctccatgaggagaagatgaaggagctgcaggctgtgagggagaaccttatcaagcagcacgagcaggaaatgtcaaggacggtgaaggtacgtgatggagagatccagaggctcaagtctgctctctgtgctctccgcgacggcagcagtgacaaagtaaggacagcgctcaccattgaggcccgggaggaggcccggaaactgtttgacacagagcgccttaagctcttacaggaaattgcggacctgaaaacggccaagaagcaggtggacgaggctctgagcaatatgatccaagcagataaaatcaaggctggggaccttcggagtgagcatcagtcccaccaagaagccatctcgaagatcaagtgggagtcggagcgggatattcggaggctgatggatgaaatcaaagccaaggacaggatcatcttttccctggaaaaggaactggagacccagacaggctatgtacagaaactccaacttcagaaggaggctttggacgaacaactctttctggtcaaggaggctgagtgcaacatgagcagcccaaaacgagaaattccaggaagggcaggtgatggttccgaacactgcagcagtcctgatttgcgaagaaatcaaaagagaatagctgaattgaatgccactataagaaaattagaagacaggaataccttgcttggagatgaacgaaatgaactgttaaaacgtgtgcgggaaaccgaaaagcaatgtaaacctctcctggaaaggaacaagtgcctcgccaagagaaacgatgaactgatggtgtccttgcagcgcatggaagaaaaactaaaagccgttaccaaggaaaattcagaaatgagagaaaaaataacatcccatccacccctgaagaaattaaaatctctgaatgacctcgaccaagctaatgaagaacaagaaacagagtttctaaaacttcaggtcattgagcaacagaacattattgatgagctcacaagggaccgagaaaagctcatccgtagaagaaagcatagaagaagttccaagccaattaagaggcctgttttggacccgtttattggctatgatgaggactctatggattcagagacatcatccatggcctcatttagaacagacagaacaccagctactcctgatgatgacttggatgaaagtttagcagctgaagaatctgaactaagatttcgacaattaacaaaagaatatcaggccctccaaagagcatatgccctcctacaggagcagacgggaggcatcatcgacgctgaacgagaagccaaggctcaagaacagctccaagcagaggtgctaaggtataaagccaaaattgaagacctggaagcgactctggctcagaaagggcagatagaaaaacaggaggcagaaaatcaccggttacaacaagaactacaggacgccagagaccagaatgagctgctggagtttcgaaacctagagctagaagagagagagagacgatcccctccatttaatctccaaattcacccattctcagatggtgtgagtgctctacagatctactgtatgaaagaaggtgttaaggatgtgaacatccctgatctcataaagcagcttgatatcttgggtgataatgggaatttaagaaatgaagaacaagtggccataattcaggccagcactgtgctgtccctggcagagaagtggatccagcagattgaaggagctgaggctgccctacaccagaaaatgatggaattggaaagtgacatggaacagttctgcaaaataaaaggctatctggaggaagaactagactacagaaaacaagctcttgaccaagcatatatgagaatccaggaactagaagctactttgtacaatgctctacagcaagaaactgttatcaagtttggtgaattattaagtgaaaaacagcaagaggagctgaggacggcagtagaaaagttacggcggcaaatgctgaggaagagcagagagtatgactgtcagattcttcaggagagaatggagctcttacagcaagcccatcagagaattcgtgacttagaagataaaacagacatccagaaaagacaaataaaagacttagaagaaaagtttctgtttctattcttgttcttctctcttgcctttattctatggccttgatgtcaaggtgcctcttaaagagtaaccgaaaacatggataagatcccaggaagacaagtgcttctaaaccttcaaagatggcaaaattgtttacaccagtgagagggagatcaaaagctaagaactaccctgtagccaggactacaactgtgtattttaaagccattattcaaggtttcttacttgacagttcctacacaaccctgttgaaaatctacaatatatgctgcatttaatgaaacatgtatatgtcaaatcagaagagaagaactataaacatatattgtgtaaagaaaaagttcagcaatggaactagtttctgcagatcaagcaaagatgtgtcttgggcatggaaccaaagttacaatgaaatattcaacccctgctgtgcaggggggtcattttaatgtaacaccacaccccatggaaacactagtcctgataataaacatcattttaaaagatcaaaacaaacaaacaaaaaaaacaagggtgggtggggagtgaagcacgaggaatacctatgaagagctatttacaataaaatgtttcatttgaaaagtctggtttcttactacagggatttgcttttctgtctttatgattgttttaaactcaggaacagagacatccgcatcgtaaatgggaagaaaaacactctctgttttgtttttctgcaaaaggtggagcttgtggaattcattccacagacgacagatgagaagtggatcacagtgaccacaacaaaactggtaacgaagtcaaaggacccgagcgaatgtgacatgtgaaataaaagcagattcgatgcttccttgtcctactctcacatctgcattcctctatcaacaatggactgatctcattcatattgaaaactaagaagatgatactgtaaatcacatgctccctgacttagttctgtttagaacgccaacatctatagggaacatgggccagagagcatctctgaatctttcatttccaaaatactgtttttcaaatggctgcttaaaattgcctgcaaatgaatatgctatatgatttgggcaaaaacacagcagaatcaatgagtaaatttctaccaagagtcgggtttgccacagagatgtgaatattaaactaaactattattttttaaagaatcctcacatgcctagagcattctgacctcttcttgtttagagtgataacattttttcccagacagatgacagcaacaagatagctctacttttttatatggaaataacattatgttactgacaaggtcattttctaccagagacaattagaggactggtacttttcctaagttgtgtattactgagtcttggagtcatctctgagagcaaatgtatgttcctgaaaagctaattttacacctcatttactgtagataacagaacaacctcaatttttcaaatttttgaagttttatttatggggctagaattcccatgcatagagaatatgtgtagggagccagaaactctttctatgaaatgctatacaaatctttccatatgtgggttcactatcatccttcagttttagcactggcatttgcaaagccagaacaataactgaagaatgtacaataaaaactagaatgctggggtcccactttttgttcttacatttactgctgacccaggtatctttggcccagtcacttaacctctctgtgcctcagtttcctcatctgcaaaatggggttaaaatgctttttcataaagttttatttgcaattttagaacaagaggtgcttaaagtagcacaatgtgctttgtaattattacaagtgctgtattatttgactttcttgtgttgttgacaaaaagattccctcatgtaataaaatagtgcttcagtttggttaaatttaagcactatagcactgaagcttgcttatcaagctacttgggacattattagcaataaaaattgagagattcaaaaccaggatctttaataatctataggaaatagatcatctcatgctattgaacaagatagaagagtgtgtcatttctatgataagcatctcccagctctcttgattgcatatgcatgccatcatacagaaccccacttttaccacaggagagccagtcattaaacaaaggcttggagcaaactgacagtatcacataattagcttgattatcttttattctggaggaaagccaggtggtatgccctactgggaagatacaaaacagactatcctgctgtattcttttttttttttttttttgagatggagtcttgctctgttgcccatgctggagtgcattggcacaatctcggctcatggcaagctccacctcctggattcaagtgattctcctgcctcaacctccctagtagctgggattacaggtgcacaccaccacacctggctaatttttgtatttttagtagagacagggtttcactatgctggtcaggctggtctcgaactcctgacctcaagtgatctgcctgcctcagcctcccaaagtgctaggattacaggtgtaagccactgtgcccggcctcctgctggattctttattcaactaggtaggttccagattaaatatgagccatatgctcattaggcaagaaatgtgaaagagggtgcctctacagtgttggtgacccaacactagccaacttgagtcagaaaatatggaagaggataaattactctcacatatctaagacttttccatttttcttcactttctgttgcagggcccatatgagtaaatctatattccgtctgctccaacacacaccttccttctcttaattttgctttcccacccaccaagaaatttgtaagtcaaaatttatttccatgagtaactatttctaaatgattgaaaatttttgaaaaagtggtatggtttatatacctaatctgcttatctgctataagtcatatgagaacaacagctaggatgattgtccaagcagctttagatgtgtttagggccaggcaaaaggtttgcttgttttttctttttgcttaagatctgggagattagcaaatttctcaagactatagactgaactgtaatttttaccaactcttgctcatgagcctcaaaatgaatatatccttgaataaagtataaatatttcaatagatacatctctctattatccattttcacaattataaaagcatcagcaaaattgtggatatgtgttccagtcactcatggatccatggaaatggaccgtgtttaaatgaatgcttcccttggatgggatgttcagcaatagc

SEQ ID NO: 2928 - DNA, 2749 bp, Homo sapiens
gtgatgctgctgctgctgctgctgccgccgccgccgcctctattgctgatactctagtggggctggaagggtggttcctattcgcaccatcgccaaccagagacagagggaaaaaaaaaaccggcagccactgctgatgttgggttcggaggctgcatccgactcggtcacaaggaaaatggattcagtttgcatctctccctcctttaaacagcttctccgggtctcagcatgggcttccagggcagcgattgaggagaccttaccaaggagcaccacacagtagatgctgagacatcgtactccaggataagaaacagtaacatggcagcacctgcttgaaagaaattaaaaaccaacagactccatttagaaaggaacaatgtccaagaaagggcgaaataagggcgagaagcccgaggcactcattgttgcccttcaagctgccaatgaagacctcaggaccaagctcacagacattcagatagagctgcatcaagagaagtccaaggtatcaaagcttgaaagagagaagactcaagaagcgaagaggattcgtgagctggagcagcgcaagcacacggtgctggtgacagaactcaaagccaagctccatgaggagaagatgaaggagctgcaggctgtgagggagaaccttatcaagcagcacgagcaggaaatgtcaaggacggtgaaggtacgtgatggagagatccagaggctcaagtctgctctctgtgctctccgcgacggcagcagtgacaaagtaaggacagcgctcaccattgaggcccgggaggaggcccggaaactgtttgacacagagcgccttaagctcttacaggaaattgcggacctgaaaacggccaagaagcaggtggacgaggctctgagcaatatgatccaagcagataaaatcaaggctggggaccttcggagtgagcatcagtcccaccaagaagccatctcgaagatcaagtgggagtcggagcgggatattcggaggctgatggatgaaatcaaagccaaggacaggatcatcttttccctggaaaaggaactggagacccagacaggctatgtacagaaactccaacttcagaaggaggctttggacgaacaactctttctggtcaaggaggctgagtgcaacatgagcagcccaaaacgagaaattccaggaagggcaggtgatggttccgaacactgcagcagtcctgatttgcgaagaaatcaaaagagaatagctgaattgaatgccactataagaaaattagaagacaggaataccttgcttggagatgaacgaaatgaactgttaaaacgtgtgcgggaaaccgaaaagcaatgtaaacctctcctggaaaggaacaagtgcctcgccaagagaaacgatgaactgatggtgtccttgcagcgcatggaagaaaaactaaaagccgttaccaaggaaaattcagaaatgagagaaaaaataacatcccatccacccctgaagaaattaaaatctctgaatgacctcgaccaagctaatgaagaacaagaaacagagtttctaaaacttcaggtcattgagcaacagaacattattgatgagctcacaagggaccgagaaaagctcatccgtagaagaaagcatagaagaagttccaagccaattaagaggcctgttttggacccgtttattggctatgatgaggactctatggattcagagacatcatccatggcctcatttagaacagacagaacaccagctactcctgatgatgacttggatgaaagtttagcagctgaagaatctgaactaagatttcgacaattaacaaaagaatatcaggccctccaaagagcatatgccctcctacaggagcagacgggaggcatcatcgacgctgaacgagaagccaaggctcaagaacagctccaagcagaggtgctaaggtataaagccaaaattgaagacctggaagcgactctggctcagaaagggcagatagaaaaacaggaggcagaaaatcaccggttacaacaagaactacaggacgccagagaccagaatgagctgctggagtttcgaaacctagagctagaagagagagagagacgatcccctccatttaatctccaaattcacccattctcagatggtgtgagtgctctacagatctactgtatgaaagaaggtgttaaggatgtgaacatccctgatctcataaagcagcttgatatcttgggtgataatgggaatttaagaaatgaagaacaagtggccataattcaggccagcactgtgctgtccctggcagagaagtggatccagcagattgaaggagctgaggctgccctacaccagaaaatgatggaattggaaagtgacatggaacagttctgcaaaataaaaggctatctggaggaagaactagactacagaaaacaagctcttgaccaagcatatatgagaatccaggaactagaagctactttgtacaatgctctacagcaagaaactgttatcaagtttggtgaattattaagtgaaaaacagcaagaggagctgaggacggcagtagaaaagttacggcggcaaatgctgaggaagagcagagagtatgactgtcagattcttcaggagagaatggagctcttacagcaagcccatcagagaattcgtgacttagaagataaaacagacatccagaaaagacaaataaaagacttagaagaaaagtcaaacagaatgccagca

SEQ ID NO: 2929 - DNA, 6626 bp, Homo sapiens
ggtgaatgagaagatgtagtgtgacagcagcccgggtgacacctgctgggagcttggcgtggacaccccagccacccccagcccagcccagccggagcaccctacccctgggcatccccctggccatccagcctcaccatgtccaagaggggcatgagcagccgggccaagggggacaaggcagaggccctcgcggcgctgcaggcggccaacgaggatcttcgagccaagctcacagacatccagatcgagctgcagcaggagaagagcaaggtcagcaaagtggaacgcgagaagaaccaggagctgcggcaggtgcgcgagcatgagcagcataagaccgcggtcttgctcacggagctcaagacaaagctgcacgaggagaagatgaaggagctacaggctgtgcgtgagacgctgctgcggcagcatgaggctgagctgctcagggtcatcaagatcaaggacaacgagaaccagcggctgcaggcactgctcagtgccctgcgtgatggcggccccgaaaaggtcaagaccgtgctgctgtccgaggccaaggaggaggccaagaaggggttcgaggtggagaaggtcaagatgcagcaggagatctccgagctcaagggcgccaaaaggcaggtggaggaggcgctgacgctggtgatccaagcggacaagatcaaggccgcagagatccgcagcgtgtaccacctgcaccaggaggagatcacccgcatcaagaaggagtgcgagcgggagatccgcaggctgatggaggagataaaatttaaagacagagcagtcttcgtgctggagagagagttaggggttcaagccgggcatgctcagagactgcagctccaaaaagaggctctagatgagcagctgtcccaggtccgagaggccgaccggcacccgggcagccccagacgggaacttcctcatgcagctggtgcaggagacgcttcagaccactcgggaagccctgaacagcagttggatgaaaaagatgcccggcgcttccagcttaaaatcgcggagttaagtgcgattatccgcaaactggaggaccgcaatgcattgctgtcggaagagaggaatgagctgttgaagcgcgtaagagaagctgagagtcagtacaagcctctgctggataaaaacaagcgcctcagtcggaagaacgaggatttgtctcatgctttacgccgaatggaaaacaagttaaaatttgtcacccaggagaacatagaaatgagacagagagctggaatcatacggagacccagttccttgaatgaccttgatcaaagtcaggatgagagagaagtcgatttcttgaagcttcagattgtggagcagcaaaacctcatagatgaactgtctaagacccttgagaccgccggctacgtgaagagcgtgttagagcgggacaagctgttaagattccggaagcaaagaaagaaaatggcaaaacttcccaagccggtggttgtggagaccttctttggatacgacgaagaggcttccctggaatccgacggctcctccgtctcttaccaaacagacaggacggaccagaccccgtgcaccccggacgatgacttggaggagggcatggccaaggaggagacggagctgaggttccggcagctgaccatggagtaccaggccctgcagcgtgcctacgctttgttgcaggagcaggttggagggacgctggacgcagagcgagaagttaagacccgtgagcagctacaagccgaagtgcagagggcacaggcgcggatagaggacctggagaaggccctggcggagcaggggcaggatatgaagtggattgaagagaagcaggcactgtaccggagaaatcaagagcttgtggaaaagatcaaacaaatggagacggaagaggctcggctcagacacgaggtgcaggacgccagagaccaaaacgagctgctggagttcaggatcctggagcttgaggagagggagaggaagtcacccgccatcagcttccaccacacgcccttcgtggacgggaagagccccctccaggtgtactgcgaggccgaaggtgtgacggacattgtggttgcggagctgatgaagaagctggacatcctgggcgataacgccaacctgaccaatgaggagcaggtggttgtcatacaagccaggacagtcctgaccttggccgaaaagtggctccagcagattgaggagacagaggcggcgctgcagcggaagatggtggatctggagagcgagaaggagctgttcagtaagcagaagggctacctggacgaggagctggactaccggaaacaggccttggaccaggccaacaagcacatcctggagctggaagccatgctgtatgatgccctgcagcaggaggccggggctaaggtggctgagctgctgtcagaggaggagcgcgagaagctcaaggtggccgtggagcagtggaagcgccaggtcatgagtgagctgcgcgagcgggacgcccagatcctgcgggagcgcatggagctgctgcagctggctcagcagagaattaaagagttagaagaaagaatagaagctcagaagagacaaataaaggaactggaggaaaagtttctatttttgttcttatttttctccttagctttcattctctggtcatagtccgtcttggcaccctgacgtgccccacattgaatcggacccttttcctccagtgggaccagaaagcagggacaaaatgggacgtcgcgtctccatcctgaagacccagggagatttggtctctgcacgcccgtcccgtggaggaagagtgagaaggggcagtgtgtggggcgtggagctgccgtccacgtgggatgtgccagaactagaactggctctgccgacttctcgggggcttctccgggacgggcctggccttggctgctggaccctgggtcccttctcccggacggcagcccccatcccatttccagggatgtgtagcattccctgccaagcaggggtgagaactgcttctgtgcagaagcaccagccgcgggtcccctcctctctcttggttctcacagtagctgccactggtgtctggaggaagattttcagaaacaacagaggcttggcctgatgacaagatgaaagctggacggtgaccttcattcaggggaacctggaggctccctgggatggtcctgggagggctccccgacgcctcaggggcccctccgatgctgcaatatgttgctggggtcctgagcacccgctggccaacagaccccacatccaccctcgttcatcatcatctctgtggggacagacaagagccgtggccgccgcgggccgcgtggtgccatcaaccctctgcctccctactcaacctgagacaggaaggccaagatcccgcccaagccgccagctgggagcaccgcgggactgagccaaggaaggcgtggggagcgtggtgacaggaggtgggacgagggggcggagctggctggaacacggatgccagaggctgcctccatagtgaatctccagaagtcacagaggccctgggcacccagagccacccagcctggaagcccctgcacgggccagccctgcaggccatggaccccggcgggcaccgaagcctcaccccaagcctttgcacacaaggagcagcccaggtggggatggcgggcgcaagaagggaaccgcggggacggcctttcccctcccgccctgtgtggggacgctgcacgagccgtggaccaagaggctgacaggaggggtccgcagcgaggaggaggtgcgaagggggcggcggctccgtcttgcaggtcccctggggcgcgttcttcaggtgcgtggtggacgaggcggcgtcctcgcggggtcgggacctgggtacccagcagcatctggctcctgcatccaccaagggcgcccaggcacagcctcaggccagaaggttcgctgcagaggttcattctagaaggagcgggagaccagcagtcccagccctgtccaaggacgcccgctgcttggcacacgagggcgccgcaggcccaccatccctcaggacatggctgccgagtccccagagacttctggtcccacagcaagagctggagctccaagcataacatctctaactgtgcggcaaggacagcgcagccagagagaggaagcagtgcattggtgaaggcaacgttaggtgtgatttccattcctgctgggagacccgggacgcagcccgggagcttcgtccagcctgtggatggagcctgactggctgcagatggaacttctgtgtcctcccaccctaggtgggctaaggttctgctctcagagctgaattgacaggaggtgtgtgtgtgtgctcacttgtgtgcacaagcatgcgtttatgcatgttttcacgcaaccagaagagccattcgtgggatttagccatttcgaggcacctagaagttgaggcagccagctgtgcagccaggtgtgactgttactggcagcattgtataaaagacacgactcagctgccgtagggaggactgggttgtctggaagtattaggctcattttatatttgtgtcagaagaaatgtctgactttggggcagatgacacggtggctgcggaccaggcatggctccctaggttgaaatcagggaaaagctaatagtatcagacagatatgctttttctttggtggctgcaggatttttgctggaaaatgcactattaatcagcacttgtccaagaaagacccatccatttctgttgtcattcaagccacagttcctgatttactcggcaagatactgggccagttcagtgtctctagctgagcctgacctcggggtttgcgtctcgagtctgaaatcctgtttagtcctctgtgcatagttttgtctcattttaacgactgcatcttcttggcacatttattatactcacaactgaatggcacacaatagccttgtgttaataaaagctaccgtggcgctgtgggtgaaccgctgggttgaagtccgatggactctacgatgcaggcatccagaaatatgttgtaactctacctggctccctgccagcctggcctcctcctctgggagagctcctggcatggtcccaatgtgtacctgcatgggaacaacagctgcatgggccagctgtttcggatctaaagatgtgcagtgaaactcacattcccagattcacatccctcatgtttatttgggtcatcatggtttagcatgttgtatatatgtctggagcacttcatacacctctatccaccacagacactcttaatcacagttctgtaataataataaggcaaactatacggcaaagagaagcatgtaaatatgtaccaaatccttatgaagttgtaattgtttatatgtaaaaagtatgtatataggaacgggagaaggtgcaaggaatgtgctgaataacatccaaactgcatcgcgtctctgccccattcctgaaagcacacatctagttggagcgtcagttcctctccttagatatcattgttttcactcgtctatcataggcaccttctttacatctgattacaatacccagcatttcagaactgggtttttgcccccaaaaaggtaaatatgagcatttatcactgactcctcctggtccagtgagcagcagcagaattcaagtatttaaaaataaggtgcatttctaaattgcaggctataccttcttttccaaaccaatgggctagagtgaatttcctccaagtacttgggctgtcttactgctagctcttctaacaggggaagtctgtatgaatgcatcaccccctaataaggcaagaggaaggaccctgaaatgttgccagaaatgtactgttacatcaacatttacattatattaacatcatcacactctgtgttcaacacacagaacaacatagatactttagtttgtctaaagtaaaaatccacataaatagcagattcctttgttgacaccagtgtgttgtttaccttgtgcccatggtccagattttgagctggagaaggactatggctgttccttaaagtctctgcccttgcagaatctgtagccttcaggataccccgagtgccttacagggcttgtgaacaccgatactagaagtcaaaaagaagagagtgcccaagtgtgggtttggaggcactgacgcattcgccaactcaccgtcatcccatccttgaaaccctgagagagagtgtgtgttttatcacagtaatggaattcagtttagcctcaggaaactcatattgtgaatataggtatcaaatcatatatttgtttactgtatattttttaaaaagctttattgtaaatttatgcaaaaactaaccgggcctgttttcttacggcggcatgccaggtagtgtgtgtattctcccaggcactcccttcatagtcaccctctaaccacgtgacattccgttccatgctaagcagtattcacaggcctaaaataggtttgtatggtgatctacaagattttacaaatatttttgtattgtgattcctatgatatataccagagaattttttactcgtttgtaaattattgtacagttttaataaaaaatgttttaaatctta

SEQ ID NO: 2930 - DNA, 1145 bp, Homo sapiens
tcctccgtcctgtccacaaggctcagcaaagcggctggcggcctggcctgggacctgctgctgctccagccatgtccatgacaaccagagcctgggaggagctggatggcggcctgggcagctgccaggccctggaggaccactctgcgctggccgagacccaggaggacagggcttcagcgacacccaggctggccgactccggcagcgtgccccacgactctcaggtggctgaaggccccagtgtggacaccaggcccaagaagatggaaaaagagcctgccgccagggggaccccaggaacggggaaggagaggctgaaagccggagcgagccctcggagcgtccccgcgcgcaagaaggcgcagaccgcgccgcccctgcagccgccgccgccgcccccggccctgagcgaggagctgccctggggagacctgtcgctcaacaagtgcctggtgctcgcctcgctggtggcgctgctgggctcggctttccagctgtgccgcgacgccgtccctggggaggcagcactccaagcacgtgtgcccgagccctgggtcccgccaagctcagccccgagggagccatcgtcgcccctgcctaagttcgaggcccaggcgcctccatcagcgccgcctgcgccccgggccgaggcagaggtcagacccaagattcccgggagtcgggaggctgcagagaacgacgaagaggagcccggcgaggccaccggagaggccgtccgggaggaccgtgtgaccctcgcagaccggggacccaaggagaggcctcggagagaggggaagccgcggaaggagaagccgcggaaggaggagagacctaagaaagagaggccgcggaaagaggagaggccacgggccgccagggagccccgggaagccctaccccagcgctgggagtcacgcgaagggggccaccggccgtgggcacgggactccagggacgccgagcccaggaagaagcaggcctgggtgtccccgaggcgtcccgacgaggagcagcggcctgggagtcgccagaagctccgcgcaggcaaggggcgggactgagccggccccgcgccggagtccaggggccccttctggacgccccgcgactctggcgaaataaagcgagtgctgcggccg

SEQ ID NO: 2931 - DNA, 4278 bp, Homo sapiens
tgggggtctcagtgcatctccttctcctctctgcctgcctcctccctcaccgaagggttagcggacacccatccttttctgcttggggaccccaccaccacccgcaacactgccgctgtctcttcttcaccgtatccttctctacccaccctcttctctcttctcttctccctgcccctttaaatctgcctggcccagcctcccccgtgatgctgggatggagcaaacattgatttgtgctgggatggaatcggaattttgatttatttttcctctcccaaccataagaagaaaaaaataataaaaacaccccctcttgagagccccctccccctttgcatccagctcccagctcttcttccctatctccatccaaggcagattttttcccctacactattctcatcttcccccacccttgccactacctcgcccccccacccagcctgctcctccagctggggagagaggggactctccggactcccccacctttcctctctgggttggagcagtctctccggaaggggagggggcttggcttgtccgggcgaggtgggagtggaggtatcctgccatggatgctgtgccggggaggcagcctgagccccagcccacatgccactcaggatgagggtccggccctgcctgccctcgctggggcccccccgcccggccccggtctaactgcccccgccccgaggcctcgcccggctccaaggcccccagcaggctctccagtcccaggatgcgctgagccgccggggggctgaggccgcgccaactacatgcatgtcccccgggggcaagttcgactttgacgacgggggctgctacgtggggggctgggaggcggggcgggcacatggctacggcgtgtgcacgggccccggcgcccagggcgagtacagcggctgctgggcacacggcttcgagtcactgggcgtcttcacggggcccggcggacacagctaccagggccactggcagcagggcaagcgcgaagggctgggcgtggagcgcaagagccgctggacgtaccgcggcgagtggctgggcgggctgaaggggcgcagcggcgtgtgggaaagcgtgtccggcctgcgctacgccgggctctggaaggacggtttccaggacggctacggcactgagacctactccgacggaggcacctaccagggccagtggcaggccgggaagcgccacggctacggggtacgccagagtgtgccctaccatcaggcggcgctgctgcgctcgccccgccgcacctccctggattccggccacagcgaccccccgacgccacccccgcccctgcccttgccgggcgacgagggaggcagccccgcctcgggctcccggggcggcttcgtgctggccgggcccggggacgccgacggcgcgtcgtcccgaaagcgcactccggcggccggcggattctttcgccgttcgctgctgctcagcgggctccgagcgggcggacgtcgcagctccctgggcagcaagcgaggctccctgcgcagcgaggtgagcagcgaggtgggcagcaccggaccgcccggctcggaggccagcgggcccccggccgcagcgccgcccgccctcatcgagggctcggccacagaggtgtacgcgggcgagtggcgcgcagatcggcgcagcggcttcggcgtcagccagcgctccaacgggctgcgctacgagggcgagtggctgggcaaccggcggcacggctacgggcgcaccacccgccccgacggctcccgcgaggagggcaagtacaagcgcaaccggctggtgcacggcgggcgcgtccgcagtctcctgcctctggcccttcggcggggcaaggttaaggagaaggtggacagggctgtcgagggcgcccgtcgagccgtgagtgctgcccgtcagcgccaggagatcgccgctgccagggcagcagacgccctcctaaaggcagtggcagccagcagtgtcgctgagaaggccgtggaggcagctcgaatggccaaactgatagcccaggacctgcagcccatgctagaggccccaggccgcagacccaggcaggactcagaaggttccgacacggagcccctggatgaggacagccctggggtatatgagaacggactgaccccctcagagggatcccctgaactgcccagcagtcctgcctcctcccgccaaccctggcgaccccctgcctgccggagcccactgcctcctggaggggaccagggtcccttctccagccccaaagcttggcctgaggagtgggggggggcaggcgcacaggcagaggaactagctggctatgaggctgaggatgaggctgggatgcaagggccagggcccagagacggttccccactcctcggaggctgcagcgacagttcaggaagtcttcgagaggaggagggggaggatgaagagcccctgcccccgctgagggccccagcaggcacggagcctgagcccatcgccatgctggtcctgaggggctcgtcctcgaggggtcctgatgctgggtgcctgacagaagagctcggggagcccgctgcaaccgagaggcctgcccagccgggagctgccaaccccctggtggtgggagccgtggccctcctggacctcagcctggcattcctgttctcccagctcctcacctgaggctacttcctggcctggttctggctttggttgcgtgcctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggg

SEQ ID NO: 2932 - DNA, 4386 bp, Homo sapiens
atctccttctcctctctgcctgcctcctccctcaccgaagggttagcggacacccatccttttctgcttggggaccccaccaccacccgcaacactgccgctgtctcttcttcaccgtatccttctctacccaccctcttctctcttctcttctccctgcccctttaaatctgcctggcccagcctcccccgtgatgctgggatggagcaaacattgatttgtgctgggatggaatcggaattttgatttatttttcctctcccaaccataagaagaaaaaaataataaaaacaccccctcttgagagccccctccccctttgcatccagctcccagctcttcttccctatctccatccaaggcagattttttcccctacactattctcatcttcccccacccttgccactacctcgcccccccacccagcctgctcctccagctggggagagaggggactctccggactcccccacctttcctctctgggttggagcagtctctccggaaggggagggggcttggcttgtccgggcgaggtgggagtggaggtatcctgccatggatgctgtgccggggaggcagcctgagccccagcccacatgagacgccgaagaaccggggcagaggggtcctgacagcagccagggaaacgggtgccctacgattctgcccagccccctctcaggacccccaaactgccatccacactcgacacttcggggttctagccactcaggatgagggtccggccctgcctgccctcgctggggcccccccgcccggccccggtctaactgcccccgccccgaggcctcgcccggctccaaggcccccagcaggctctccagtcccaggatgcgctgagccgccggggggctgaggccgcgccaactacatgcatgtcccccgggggcaagttcgactttgacgacgggggctgctacgtggggggctgggaggcggggcgggcacatggctacggcgtgtgcacgggccccggcgcccagggcgagtacagcggctgctgggcacacggcttcgagtcactgggcgtcttcacggggcccggcggacacagctaccagggccactggcagcagggcaagcgcgaagggctgggcgtggagcgcaagagccgctggacgtaccgcggcgagtggctgggcgggctgaaggggcgcagcggcgtgtgggaaagcgtgtccggcctgcgctacgccgggctctggaaggacggtttccaggacggctacggcactgagacctactccgacggaggcacctaccagggccagtggcaggccgggaagcgccacggctacggggtacgccagagtgtgccctaccatcaggcggcgctgctgcgctcgccccgccgcacctccctggattccggccacagcgaccccccgacgccacccccgcccctgcccttgccgggcgacgagggaggcagccccgcctcgggctcccggggcggcttcgtgctggccgggcccggggacgccgacggcgcgtcgtcccgaaagcgcactccggcggccggcggattctttcgccgttcgctgctgctcagcgggctccgagcgggcggacgtcgcagctccctgggcagcaagcgaggctccctgcgcagcgaggtgagcagcgaggtgggcagcaccggaccgcccggctcggaggccagcgggcccccggccgcagcgccgcccgccctcatcgagggctcggccacagaggtgtacgcgggcgagtggcgcgcagatcggcgcagcggcttcggcgtcagccagcgctccaacgggctgcgctacgagggcgagtggctgggcaaccggcggcacggctacgggcgcaccacccgccccgacggctcccgcgaggagggcaagtacaagcgcaaccggctggtgcacggcgggcgcgtccgcagtctcctgcctctggcccttcggcggggcaaggttaaggagaaggtggacagggctgtcgagggcgcccgtcgagccgtgagtgctgcccgtcagcgccaggagatcgccgctgccagggcagcagacgccctcctaaaggcagtggcagccagcagtgtcgctgagaaggccgtggaggcagctcgaatggccaaactgatagcccaggacctgcagcccatgctagaggccccaggccgcagacccaggcaggactcagaaggttccgacacggagcccctggatgaggacagccctggggtatatgagaacggactgaccccctcagagggatcccctgaactgcccagcagtcctgcctcctcccgccaaccctggcgaccccctgcctgccggagcccactgcctcctggaggggaccagggtcccttctccagccccaaagcttggcctgaggagtgggggggggcaggcgcacaggcagaggaactagctggctatgaggctgaggatgaggctgggatgcaagggccagggcccagagacggttccccactcctcggaggctgcagcgacagttcaggaagtcttcgagaggaggagggggaggatgaagagcccctgcccccgctgagggccccagcaggcacggagcctgagcccatcgccatgctggtcctgaggggctcgtcctcgaggggtcctgatgctgggtgcctgacagaagagctcggggagcccgctgcaaccgagaggcctgcccagccgggagctgccaaccccctggtggtgggagccgtggccctcctggacctcagcctggcattcctgttctcccagctcctcacctgaggctacttcctggcctggttctggctttggttgcgtgcctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaa

SEQ ID NO: 2933 - DNA, 2483 bp, Homo sapiens
gatgctgtgccggggaggcagcctgagccccagcccacatgagacgccgaagaaccggggcagaggggtcctgacagcagccagggaaacgggtgccctacgattctgcccagccccctctcaggacccccaaactgccatccacactcgacacttcggggttctagccactcaggatgagggtccggccctgcctgccctcgctggggcccccccgcccggccccggtctaactgcccccgccccgaggcctcgcccggctccaaggcccccagcaggctctccagtcccaggatgcgctgagccgccggggggctgaggccgcgccaactacatgcatgtcccccgggggcaagttcgactttgacgacgggggctgctacgtggggggctgggaggcggggcgggcacatggctacggcgtgtgcacgggccccggcgcccagggcgagtacagcggctgctgggcacacggcttcgagtcactgggcgtcttcacggggcccggcggacacagctaccagggccactggcagcagggcaagcgcgaagggctgggcgtggagcgcaagagccgctggacgtaccgcggcgagtggctgggcgggctgaaggggcgcagcggcgtgtgggaaagcgtgtccggcctgcgctacgccgggctctggaaggacggtttccaggacggctacggcactgagacctactccgacggaggcacctaccagggccagtggcaggccgggaagcgccacggctacggggtacgccagagtgtgccctaccatcaggcggcgctgctgcgctcgccccgccgcacctccctggattccggccacagcgaccccccgacgccacccccgcccctgcccttgccgggcgacgagggaggcagccccgcctcgggctcccggggcggcttcgtgctggccgggcccggggacgccgacggcgcgtcgtcccgaaagcgcactccggcggccggcggattctttcgccgttcgctgctgctcagcgggctccgagcgggcggacgtcgcagctccctgggcagcaagcgaggctccctgcgcagcgaggtgagcagcgaggtgggcagcaccggaccgcccggctcggaggccagcgggcccccggccgcagcgccgcccgccctcatcgagggctcggccacagaggtgtacgcgggcgagtggcgcgcagatcggcgcagcggcttcggcgtcagccagcgctccaacgggctgcgctacgagggcgagtggctgggcaaccggcggcacggctacgggcgcaccacccgccccgacggctcccgcgaggagggcaagtacaagcgcaaccggctggtgcacggcgggcgcgtccgcagtctcctgcctctggcccttcggcggggcaaggttaaggagaaggtggacagggctgtcgagggcgcccgtcgagccgtgagtgctgcccgtcagcgccaggagatcgccgctgccagggcagcagacgccctcctaaaggcagtggcagccagcagtgtcgctgagaaggccgtggaggcagctcgaatggccaaactgatagcccaggacctgcagcccatgctagaggccccaggccgcagacccaggcaggactcagaaggttccgacacggagcccctggatgaggacagccctggggtatatgagaacggactgaccccctcagagggatcccctgaactgcccagcagtcctgcctcctcccgccaaccctggcgaccccctgcctgccggagcccactgcctcctggaggggaccagggtcccttctccagccccaaagcttggcctgaggagtgggggggggcaggcgcacaggcagaggaactagctggctatgaggctgaggatgaggctgggatgcaagggccagggcccagagacggttccccactcctcggaggctgcagcgacagttcaggaagtcttcgagaggaggagggggaggatgaagagcccctgcccccgctgagggccccagcaggcacggagcctgagcccatcgccatgctggtcctgaggggctcgtcctcgaggggtcctgatgctgggtgcctgacagaagagctcggggagcccgctgcaaccgagaggcctgcccagccgggagctgccaaccccctggtggtgggagccgtggccctcctggacctcagcctggcattcctgttctcccagctcctcacctgaggctacttcctggcctggttctggctttggttgcgtgcctcttcacccctttgacctgccttttttctcttctcctcttcctggctgtgttttctcctatctttctttctcttcttcctttcttttctgtgctccctccttcctcccctctcaacctttacttctgatttctatttcatggaatttgggattgaagttaaactacaacagtgccgccaacaccaagtcttgcaggaaaaaaatacaaagaaatttaac

SEQ ID NO: 2934 - DNA, 4312 bp, Homo sapiens
ggtccgcggcgctgccggcccctcctcgccgccgcggagctggaccgcagttgtgccccgccgaccatgcgccgcctcccgcgggccctgctgctgcagctgcgcctcgccctgctggtggccgcgggggccccggaggtgctggtcagcgcgccgcggagcctggtgtgggggcccgggctgcaggcggccgtcgtcctgccggtccgctatttctacctgcaggcggtcaactcggagggccagaacctcactcgctctcccgcaggtgaaacaccattcaaagtcgtagtcaaatctctttcacctaaagagttggtccggatacatgtccctaaacctttggacaggaatgatggaacatttttgatgagatataggatgtatgaaactgtcgatgaaggcctgaagatagaggtcctttatggtgatgaacatgtggctcagtctccctatattttgaaaggaccagtgtaccatgagtactgtgagtgtccggaagatcctcaggcctggcagaagactctttcttgtccaaccaaggaaccacagattgcaaaagattttgcttcctttcccagcatcaatctccagcaaatgctaaaagaagtccccaaaaggtttggggatgagagaggtgccattgttcattacacgattctcaataaccatgtttaccggagatctttagggaaatacacagacttcaagatgttctctgatgagattttgttatcattgacaagaaaggtccttctcccagatttagaattttatgttaatcttggagattggcccttggagcatcgaaaagtcaatggaacccctagccccatacctatcatttcatggtgtggctctctggattcaagagatgttgtccttccaacgtatgacatcacccactccatgcttgaagccatgcggggtgttacaaatgatctcctctctattcagggaaatacagggccttcctggatcaataaaacagagagagctttcttcagaggtagagacagccgagaggagaggctccagttggtacagctgtccaaagaaaatcctcagctactagatgcaggaattacaggatatttctttttccaagagaaagaaaaggagcttggaaaagccaagttgatgggtttctttgatttctttaagtacaagtatcaagtaaatgtggatgggaccgtggctgcttacagatatccatatctcatgctgggcgacagtctggttttaaagcaggactcgccatattatgaacatttctacatggcactagaaccttggaagcattatgttccaattaaaagaaatctgagtgatttattagagaaagttaaatgggctaaggaaaatgatgaagaagccaagaagattgcaaaagaaggacagttgatggctagggacctactacagccacacaggctttactgctactattaccaagtactgcagaaatatgccgagcgccagtccagcaaacccgaagtacgtgatggaatggaacttgttcctcagccagaagatagcacagccatctgccagtgccacaggaaaaagccttcaagagaagaactttgagtcagcccagaatcacactcctgtgtatcccggctacactttaaggaaagattgaatctaagctgtgaaggacagtatagaagactgcaccaagtggactagttctcccggtggctttatatatgtagatggatatagcagtactggttgagtatccctcatctgaaatgcttaggaccaggagtgtttcaggcttcagattttttaagatttgggaatatttgcatgtacataatgaggtatcttggggatgagatccaagtctaaacacaaaattcatttatattttatatataccttgttcacataccctgaaggtaattttatataatatttttaataatttgtgcatgaaacaaagtttgtatacattgaactgtcagaaagcaaaggtgtcactatcttagcgacccaagtggtggtgtcagcactcaaaaagttttggattttggggtatttcagattttagatttttgtatgaggaatgttcaacctgtatttgaacaagcattaccaaatatcattgaatattaatatcttttgcgtaaaaactgctattatcagcatcatagtttctctaaaaagaaaacttggggatcatagccgatagagagacttgctaaaatataaatcagcctctgcaaaactgtttacatatttattggtttacatattttattggtttatttctatcccctgttcactttttctcttccacttccaattatgaagagaaaatatttgttcagggttgtccccccgccccccgtcactgcataatttctcctcttacaagctgcttttggctttcattaataacagcttccttttagaaggtctgataaggatatttaaggaagaagagaatgactctgttattaaaggtggcatggagactgtggagggaatattttttaaagcactactcatatcctttaaactaaattttgccaaagcccgagacaacattaaggagaaattgtaccttaagttagtaattccaaatctatctgagttgtatacccatcaaagacaatacagttattaacatagatgaaggtatgctataggcatcattcattatctctatattgaataggtgaaagataactgtagtcaggtgaaaggcattcattatttttaagctgaaaaggggatccttgaaaacactgaaaacctctacaacaatcttcaggaagcctgctatcttgggattcactaataataggccaagaacaaaggcaagcatccattcctcactccaccacttttctatttcagtgggtgtcgttgctacgatgaagactttggaaatttcctttctcttttaggacagggtcaggatttaggactcatagcctgaaagctcattacatactccttgtaaccatcagtccaaggttcagttcactaaagtgcatgttctaaaacaagagctatcctcattccaaattttaaaatatgtactctggccggttgcagtggctcacgcctgtaatcccagcactttggcaggccgagatgggcggatcttttgaggtcaggagtttgagaccagcctggccaacatggtgaaaccccgtctctactaaaaatacaaaaattagccaggcatggtggcatttgcctgtaatcccagctactcgggaggctgaggcaggagaatcacttgaacctgggaggcagaggttgcagtgagctgagattacaccactgcactccagcctgggtgacagagtgagactccatctcaaaaactgaaaataaaaataaaaatatgtattctcctaactgaaatatttacttaatctggaaaacaatgtaactatttttaaagtggttacatctattcttgctgaagaacaataaacagaattttttgactaagcataaccaaatttcagaacagtctaatcaatgccaagtatccaaggcaaactctaatacccatccattgtgcaaaaccacaagcacgcaagtattaaataagagcaagctgtcctgagcccatacctaatgaatttgtgtcttaaatattgtacattgtgtttgaggcttgtcaaaactgggattatggcaagaaaggttgcctaactcatacctttctgcctcaaattccaggtgctaaaggctaatggcattttaaacatcttacatttttaaaaatttatattgcctctgccaaacaggcctaatagttaaaagcaagttgagacaaaccaggcagattcagtgtgtggaacaggaaggatgtgctttaaaaaaaggtggaatccctcaaaaaattctatagggagacagcagccttaatctacataattcttcatctcgccaattcagccgcagcctttaaagagttagtgttaatggctttctggtttgaaaacaaaaatgcatctatgtggttgaaagtttgggaggagattcaccaatatctgaggagaagatggagtgaagggaattcttactttttgctttatacctttctataatatttagatttttttttactgtaagtatggatcaaattgcaaaataaagaaaaatgccaaccttagaaaagacaataaatgcacaaaagatataaacaggaacagcaaatatttatattttttccattttgctctttttaaatctatgtttagaactttatatcttgggacttatgtatatatataccttttaaataaaataaattttctaaataaaaagttgaaaaaga

SEQ ID NO: 2935 - DNA, 1533 bp, Homo sapiens
tatagtcccagctactcatggggctgatgcaggttgaggcaggaggttcatgagcccaggaggttggagctgtaatgagctaggattctgcctctgcactcctagctggatgacagagcaagaccctgtctcaaaaaagaaaaaaaaaaaaaaaagaatgcatgaaccagacatgacagttcctggcctcaaagatcttccaaaggaaatgatttttttttaaccaccaatgctgcaggaaaaagcaacatatttaagttatccaataacacctatccaataattgtaaatcattatcatgacatggtagagttgtttatatttcttttccttttaggtgaaacaccattcaaagtcgtagtcaaatctctttcacctaaagagttggtccggatacatgtccctaaacctttggacaggaatgatggaacatttttgatgagatataggatgtatgaaactgtcgatgaaggcctgaagatagaggtcctttatggtgatgaacatgtggctcagtctccctatattttgaaaggaccagtgtaccatgagtactgtgagtgtccggaagatcctcaggcctggcagaagactctttcttgtccaaccaaggaaccacagattgcaaaagattttgcttcctttcccagcatcaatctccagcaaatgctaaaagaagtccccaaaaggtttggggatgagagaggtgccattgttcattacacgattctcaataaccatgtttaccggagatctttagggaaatacacagacttcaagatgttctctgatgagattttgttatcattgacaagaaaggtccttctcccagatttagaattttatgttaatcttggagattggcccttggagcatcgaaaagtcaatggaacccctagccccatacctatcatttcatggtgtggctctctggattcaagagatgttgtccttccaacgtatgacatcacccactccatgcttgaagccatgcggggtgttacaaatgatctcctctctattcagggaaatacagggccttcctggatcaataaaacagagagagctttcttcagaggtagagacagccgagaggagaggctccagttggtacagctgtccaaagaaaatcctcagctactagatgcaggaattacaggatatttctttttccaagagaaagaaaaggagcttggaaaagccaagttgatgggtttctttgatttctttaagtacaagtatcaagtaaatgtggatgggaccgtggctgcttacagatatccatatctcatgctgggcgacagtctggttttaaagcaggactcgccatattatgaacatttctacatggcactagaaccttggaagcattatgttccaattaaaagaaatctgagtgatttattagagaaagttaaatgggctaagagtttcactctgtcgcccaggctggaatgcagtggcacgatctccactcactgcaacctctgcctcccgggttcaaggaatttcgtgcctcagcctcctgagtag

SEQ ID NO: 2936 - DNA, 4374 bp, Homo sapiens
tatagtcccagctactcatggggctgatgcaggttgaggcaggaggttcatgagcccaggaggttggagctgtaatgagctaggattctgcctctgcactcctagctggatgacagagcaagaccctgtctcaaaaaagaaaaaaaaaaaaaaaagaatgcatgaaccagacatgacagttcctggcctcaaagatcttccaaaggaaatgatttttttttaaccaccaatgctgcaggaaaaagcaacatatttaagttatccaataacacctatccaataattgtaaatcattatcatgacatggtagagttgtttatatttcttttccttttaggtgaaacaccattcaaagtcgtagtcaaatctctttcacctaaagagttggtccggatacatgtccctaaacctttggacaggaatgatggaacatttttgatgagatataggatgtatgaaactgtcgatgaaggcctgaagatagaggtcctttatggtgatgaacatgtggctcagtctccctatattttgaaaggaccagtgtaccatgagtactgtgagtgtccggaagatcctcaggcctggcagaagactctttcttgtccaaccaaggaaccacagattgcaaaagattttgcttcctttcccagcatcaatctccagcaaatgctaaaagaagtccccaaaaggtttggggatgagagaggtgccattgttcattacacgattctcaataaccatgtttaccggagatctttagggaaatacacagacttcaagatgttctctgatgagattttgttatcattgacaagaaaggtccttctcccagatttagaattttatgttaatcttggagattggcccttggagcatcgaaaagtcaatggaacccctagccccatacctatcatttcatggtgtggctctctggattcaagagatgttgtccttccaacgtatgacatcacccactccatgcttgaagccatgcggggtgttacaaatgatctcctctctattcagggaaatacagggccttcctggatcaataaaacagagagagctttcttcagaggtagagacagccgagaggagaggctccagttggtacagctgtccaaagaaaatcctcagctactagatgcaggaattacaggatatttctttttccaagagaaagaaaaggagcttggaaaagccaagttgatgggtttctttgatttctttaagtacaagtatcaagtaaatgtggatgggaccgtggctgcttacagatatccatatctcatgctgggcgacagtctggttttaaagcaggactcgccatattatgaacatttctacatggcactagaaccttggaagcattatgttccaattaaaagaaatctgagtgatttattagagaaagttaaatgggctaaggaaaatgatgaagaagccaagaagattgcaaaagaaggacagttgatggctagggacctactacagccacacaggctttactgctactattaccaagtactgcagaaatatgccgagcgccagtccagcaaacccgaagtacgtgatggaatggaacttgttcctcagccagaagatagcacagccatctgccagtgccacaggaaaaagccttcaagagaagaactttgagtcagcccagaatcacactcctgtgtatcccggctacactttaaggaaagattgaatctaagctgtgaaggacagtatagaagactgcaccaagtggactagttctcccggtggctttatatatgtagatggatatagcagtactggttgagtatccctcatctgaaatgcttaggaccaggagtgtttcaggcttcagattttttaagatttgggaatatttgcatgtacataatgaggtatcttggggatgagatccaagtctaaacacaaaattcatttatattttatatataccttgttcacataccctgaaggtaattttatataatatttttaataatttgtgcatgaaacaaagtttgtatacattgaactgtcagaaagcaaaggtgtcactatcttagcgacccaagtggtggtgtcagcactcaaaaagttttggattttggggtatttcagattttagatttttgtatgaggaatgttcaacctgtatttgaacaagcattaccaaatatcattgaatattaatatcttttgcgtaaaaactgctattatcagcatcatagtttctctaaaaagaaaacttggggatcatagccgatagagagacttgctaaaatataaatcagcctctgcaaaactgtttacatatttattggtttacatattttattggtttatttctatcccctgttcactttttctcttccacttccaattatgaagagaaaatatttgttcagggttgtccccccgccccccgtcactgcataatttctcctcttacaagctgcttttggctttcattaataacagcttccttttagaaggtctgataaggatatttaaggaagaagagaatgactctgttattaaaggtggcatggagactgtggagggaatattttttaaagcactactcatatcctttaaactaaattttgccaaagcccgagacaacattaaggagaaattgtaccttaagttagtaattccaaatctatctgagttgtatacccatcaaagacaatacagttattaacatagatgaaggtatgctataggcatcattcattatctctatattgaataggtgaaagataactgtagtcaggtgaaaggcattcattatttttaagctgaaaaggggatccttgaaaacactgaaaacctctacaacaatcttcaggaagcctgctatcttgggattcactaataataggccaagaacaaaggcaagcatccattcctcactccaccacttttctatttcagtgggtgtcgttgctacgatgaagactttggaaatttcctttctcttttaggacagggtcaggatttaggactcatagcctgaaagctcattacatactccttgtaaccatcagtccaaggttcagttcactaaagtgcatgttctaaaacaagagctatcctcattccaaattttaaaatatgtactctggccggttgcagtggctcacgcctgtaatcccagcactttggcaggccgagatgggcggatcttttgaggtcaggagtttgagaccagcctggccaacatggtgaaaccccgtctctactaaaaatacaaaaattagccaggcatggtggcatttgcctgtaatcccagctactcgggaggctgaggcaggagaatcacttgaacctgggaggcagaggttgcagtgagctgagattacaccactgcactccagcctgggtgacagagtgagactccatctcaaaaactgaaaataaaaataaaaatatgtattctcctaactgaaatatttacttaatctggaaaacaatgtaactatttttaaagtggttacatctattcttgctgaagaacaataaacagaattttttgactaagcataaccaaatttcagaacagtctaatcaatgccaagtatccaaggcaaactctaatacccatccattgtgcaaaaccacaagcacgcaagtattaaataagagcaagctgtcctgagcccatacctaatgaatttgtgtcttaaatattgtacattgtgtttgaggcttgtcaaaactgggattatggcaagaaaggttgcctaactcatacctttctgcctcaaattccaggtgctaaaggctaatggcattttaaacatcttacatttttaaaaatttatattgcctctgccaaacaggcctaatagttaaaagcaagttgagacaaaccaggcagattcagtgtgtggaacaggaaggatgtgctttaaaaaaaggtggaatccctcaaaaaattctatagggagacagcagccttaatctacataattcttcatctcgccaattcagccgcagcctttaaagagttagtgttaatggctttctggtttgaaaacaaaaatgcatctatgtggttgaaagtttgggaggagattcaccaatatctgaggagaagatggagtgaagggaattcttactttttgctttatacctttctataatatttagatttttttttactgtaagtatggatcaaattgcaaaataaagaaaaatgccaaccttagaaaagacaataaatgcacaaaagatataaacaggaacagcaaatatttatattttttccattttgctctttttaaatctatgtttagaactttatatcttgggacttatgtatatatataccttttaaataaaataaattttctaaataaaaagttg

SEQ ID NO: 2937 - DNA, 1557 bp, Homo sapiens
ctcttcccggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaaccttt

SEQ ID NO: 2938 - DNA, 2884 bp, Homo sapiens
ggcggggcctggccccgctctcccagggtgccccgcgcgcgcgcgcgccggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctatttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttaattacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaatattttta

SEQ ID NO: 2939 - DNA, 655 bp, Homo sapiens
atgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttc

SEQ ID NO: 2940 - DNA, 1728 bp, Homo sapiens
ccggccaagagtgcgtgggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaagtccttaagggaaagaagttaagtcttccaatgccaatctgaggaccttcagagacagtctacgccttaacaagcacatgaaggaaactattttgaatgttctctttggcaacttatccataatttgggatcaaatgttaaaaccagaaaagtgtttagtgtggatttcagcaaaacctgatcatcccacccagaagaccttctcatcaatagatcgcccttaaagacccattgtaaggtcataaaaaacctcggccacctgcacaaagatggtgcctcactgcaacaagaaaccttaaggtgtcttaccgacgaaataaaaaacataaatgattgttctccaaggcctgagggcaagactcatgatgagcaagtcaaccccaatctggaacaatgtccctcctcttagaatgtcccaactaaagaccagttaaaatattagggtacgttcttgtgaatttccactttccaggtagatgaccaaatttaggtggtcaagatataaaggtgtcagctagttttaagtgtgaaacttatttcactttcacactgccttcaggccagaagcaaaccaaatttaccaggtttggctggaggagttttgtgactcatcttttactggtttgaattttttcaaaccagtggctgatacctgccttgtacttagtaccttaataccaataacctaatggtacttaggcgagtaccatttgcacaatcactgttttacttatgagcagatacagatatatccaaacccttacctactaggtatcctgctagggttttcaattccaattcttgtattaagttttttcctttcagttttaggtgcgaaagtaatcagtcaatccaatatcccccatctttgtcttgaaacaaaaactgttttaagacgtctacgttgaattattcagagaattaagcaataaaagctcacaccttattgtcaa

SEQ ID NO: 2941 - DNA, 931 bp, Homo sapiens
gggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaaggtaggtcctgggatgacagcaatgctgacactggcctaaggagttactcatccatttaataagtattccagcagatacagatgtgaacagtcaagtctctgccatccacaatgcttgtgttctaatgcaagaagacaaatattttcaataaagaaacaaatgccataaaaa

SEQ ID NO: 2942 - DNA, 5055 bp, Homo sapiens
aattattaatcagattcttgacattcctcagccccaggttggctggagaagcatgttccccagaggagcagaggcccaggactggcatttggatatgcagctgaccggcaaggtggtgctgtcagccgctgccctgctcctggtgactgtggcctacaggctgtacaagtcgaggcctgccccagcccagcggtggggtgggaatggccaggcagaagccaaggaggaagcagagggctcagggcagcctgctgtacaggaggcttctcctggggtgctcctgagggggccaagacgtcggaggagcagcaagcgggctgaagcaccacagggctgcagctgtgagaatccaagaggcccctatgtcctggtcacgggggccacttccacagacaggaagccccagagaaaaggctcaggtgaggagcggggcgggcagggctcggactctgagcaggtgcctccttgctgccccagccaggaaaccagaacagctgttggcagtaaccctgaccctccccatttcccccgcttgggcagcgaaccgaagagctccccagctggactcattgcagcagccgacggcagctgtgccggtggtgagccttctccatggcaggacagtaaaccccgtgagcatccaggactggggcaactagaacctccccactgtcactacgtggctcccttgcaaggcagcagtgacatgaaccagagctgggtcttcacccgtgtgataggggtcagcagagaagaggctggggctctcgaggctgcctccgatgttgacctgaccctgcatcagcaggagggcgcccccaactcctcctataccttctcatccatagcccgcgtccgaatggaggagcatttcatacagaaggcggagggggttgagccccggctcaagggcaaggtgtacgactactatgtggaatctacctctcaggccatcttccagggcaggctggctcccaggacagcagccctgactgaggttccatcccctaggccaccgccagggtccctgggaacaggggctgcctcgggaggccaagccggtgacacaaagggtgcagccgaaagagccgcctccccgcagacagggccgtggccctccacccgaggcttcagccggaaggagagccttctgcagatagcggagaacccagagctgcagctgcagccagatggcttccggctccccgctccaccctgcccagacccgggcgccctgcctggcttaggcagaagcagccgggagccccatgtgcagccggtggccgggaccaatttcttccatatcccgctcacccctgcttcagccccacaggtccgcctggatctgggcaattgctatgaggtgctgaccttggccaagaggcagaacctggaggccctgaaagaggcggcctacaaggtgatgagcgaaaactacctgcaggtgctgcgcagcccggacatctacgggtgcctgagcggggcagagcgcgagctgatcctgcagcgccggctccggggccgccagtacctggtggtggctgacgtgtgccccaaggaagactccggcggcctctgttgctatgacgatgagcaggatgtctggcgcccgctggctcgcatgccccccgaggccgtgtcccggggctgtgccatctgcagtctcttcaattatctcttcgtggtgtccggctgccaggggcccgggcaccagccctccagccgcgtcttctgctacaacccgctcacggggatctggagcgaggtgtgcccgctgaaccaggcccggccgcactgccggctggtggccctggacgggcacctgtatgccatcggcggagagtgtctgaactcggtggagcgttacgacccccgcctggaccgctgggactttgccccgccgctccccagtgacacgttcgccctggcgcacacggccacggtgcgtgccaaggaaatcttcgtcaccggcggctcgctgcgcttcctgctgttccgcttctctgcgcaggagcagcgctggtgggccggccccaccgggggcagcaaggaccgcacggccgagatggtggcggtcaacggctttctctaccgctttgacctcaaccgcagcctgggcatcgccgtgtaccgctgcagcgccagcacccggctctggtacgagtgcgccacgtaccggacgccttacccggatgccttccagtgcgccgtggtggacaacctcatctactgcgtgggacgccggagcaccctctgcttcctagcagactctgtctcacccaggtttgtgcccaaggagctgcggagtttcccggccccgcagggcaccctcctgcccaccgtcctgaccttgcccacccccgatttgcctcagaccagggtctagcagtccctcaactgagctcctcatgcaaagctgggggccaccgggctccactgccagccgtccctctgggggccatttctaggcaaacaggcaacccaggaatgtggccatcaagaggtgaattccggtcctttctcctcccctagctggggagagagggatcttagatgagtcttacccttcatgggctgcagaggccccactgcagaaaagaggaccaggagctggtgttccaaggcagaaggcattcatgtcttcagggatgaccgcccttgcttcaactctgaattcttggggggatacaccgggaccccaccaaagcttagggggcatagtctttttgcaatcacaattctaggagccagttgaccccagcagcccctcgctagttgctctggagaggggttggctctctgagccatcagtgccccttcctaaacatcagccactgggccccacctccacagttcccagaagcaccgggacacacaggtgggaaagatggaggcaggtgacttgggcagggccaggaaggagccgagggagccccaggggccctggccagagggagtggtggtttgaaaagtagaacagctgaagctggggccagcctaggagactcttgcttgcgagaaaatataccaaagcccacattacttttctccttattggaagaaagagaagcagccattgtaccaagctatcttctggtggaggtctgctaaggatacacggaggtctcagcaaagggaagaaactatgtgatccaagggccaccctgctcctcggccctgcccatgttaactgaccattgcactcattctcagatctgtagccgtcttcctgtctggaagctggggcaaccaccaccagtcagcacttcagggtgacagcataatttgccctccttgtgccaggtacggtcacctggtttgccgcattcacattttcaggtggatgaccaagcggaggaactagaagagtctagtgaagcatccagagactggatctcctttcacatctggtttgataaactccgaatgaaggagacccccagcctcaggaaagcacctgtccttccaggagggacgggagagagcctgacccagtgtattaccacagcccttgttccacctctgagggagacagtgacagatgggaaggcagtgatgctcttggtcccagccagaagccaggggagatgggaggtacaccagagcagggcctgacaaggaagaaaataaggatgctttggacctcagtgtccttgtcttgaaaatgggaaggacaattcatgtccctgtctgccctggggataaatgagaggataaaagagaaagttcttcccagtttcccaggtggtcccagctagatcctgtgtccacggaagctgctggtgcccaggctgtgggtcttgttggaagaagcaggactggaacaaaggatgaaaaggaggttggcatggacataagaggagagcttgcactggaccaccgaagaccaccatccctggtctgggctctggcaccaggctctgccagtggcagctcagaggccacagggtgacattggccacacccccaccccacttccctggcctgggcctcgaaagatgaagcaactgaatttattcttaaatcagagaccaggaagggaaagtcagctggggccatggctaccttcttgggagagtgacccctgaacccagccaaggccacattcaagctcagtgtcaacactaggcatgaacctccaagggacctgtgggctggggcagaatggcttcagtgacaagactcaaaggaggcactagcattgtgctgctggactgggggaaggacttgcttgggaggagaactctacataggagctgggggcaggtggacctagatccaaccttcaacccctagtgaggggccaggcagaggacaaggcaacaactaagctaggtaaagttctggaaagtttccaagcccaggaggaacaaggaccactctggaaaaacattccaaagcccattgcatacctgtggtagagactaggggagtgattccagggataagacggacaaatgtgttccaggccccagctgatggtgggtgtggtcttcataatgagaggtggagctgagatttgggcctgggctgggaagaggagtacacagtccatctgatccacctctcttatggttccattggcaaaatcattcatcagtcgtcctatcttttcctggcgagcgctcacaatggcttcataagtgtttcaatacagtgtcccaggcagtcactacctatagattagagctgatgtgctggcctggggctctagagctgggcttcaggaagaatgtggtcagggccatcagggtggaacaaggtagctcaagaccttggaaagacaccctgagggcacaatcgtccttgcagtttaagatgacactttaaaaataaattctttcctaatgatggcttgagtcctgccactcaatgggagcatcagcggaacccgtagcatcttatttggaattgacattctctattgtaattttgttcctgtttatttttaagttttctttttgtttcactggaaaggaaagatgatgctctgttttaaacattaaaagtatacaagttgctttgttacaataaaactaaatatgtacacacacc

SEQ ID NO: 2943 - DNA, 4088 bp, Homo sapiens
gggcagcctgctgtacaggaggcttctcctggggtgctcctgagggggccaagacgtcggaggagcagcaagcgggctgaagcaccacagggctgcagctgtgagaatccaagaggcccctatgtcctggtcacgggggccacttccacagacaggaagccccagagaaaaggctcaggtgaggagcggggcgggcagggctcggactctgagcaggtgcctccttgctgccccagccaggaaaccagaacagctgttggcagtaaccctgaccctccccatttcccccgcttgggcagcgaaccgaagagctccccagctggactcattgcagcagccgacggcagctgtgccggtggtgagccttctccatggcaggacagtaaaccccgtgagcatccaggactggggcaactagaacctccccactgtcactacgtggctcccttgcaaggcagcagtgacatgaaccagagctgggtcttcacccgtgtgataggggtcagcagagaagaggctggggctctcgaggctgcctccgatgttgacctgaccctgcatcagcaggagggcgcccccaactcctcctataccttctcatccatagcccgcgtccgaatggaggagcatttcatacagaaggcggagggggttgagccccggctcaagggcaaggtgtacgactactatgtggaatctacctctcaggccatcttccagggcaggctggctcccaggacagcagccctgactgaggttccatcccctaggccaccgccagggtccctgggaacaggggctgcctcgggaggccaagccggtgacacaaagggtgcagccgaaagagccgcctccccgcagacagggccgtggccctccacccgaggcttcagccggaaggagagccttctgcagatagcggagaacccagagctgcagctgcagccagatggcttccggctccccgctccaccctgcccagacccgggcgccctgcctggcttaggcagaagcagccgggagccccatgtgcagccggtggccgggaccaatttcttccatatcccgctcacccctgcttcagccccacaggtccgcctggatctgggcaattgctatgaggtgctgaccttggccaagaggcagaacctggaggccctgaaagaggcggcctacaaggtgatgagcgaaaactacctgcaggtgctgcgcagcccggacatctacgggtgcctgagcggggcagagcgcgagctgatcctgcagcgccggctccggggccgccagtacctggtggtggctgacgtgtgccccaaggaagactccggcggcctctgttgctatgacgatgagcaggatgtctggcgcccgctggctcgcatgccccccgaggccgtgtcccggggctgtgccatctgcagtctcttcaattatctcttcgtggtgtccggctgccaggggcccgggcaccagccctccagccgcgtcttctgctacaacccgctcacggggatctggagcgaggtgtgcccgctgaaccaggcccggccgcactgccggctggtggccctggacgggcacctgtatgccatcggcggagagtgtctgaactcggtggagcgttacgacccccgcctggaccgctgggactttgccccgccgctccccagtgacacgttcgccctggcgcacacggccacggtgcgtgccaaggaaatcttcgtcaccggcggctcgctgcgcttcctgctgttccgcttctctgcgcaggagcagcgctggtgggccggccccaccgggggcagcaaggaccgcacggccgagatggtggcggtcaacggctttctctaccgctttgacctcaaccgcagcctgggcatcgccgtgtaccgctgcagcgccagcacccggctctggtacgagtgcgccacgtaccggacgccttacccggatgccttccagtgcgccgtggtggacaacctcatctactgcgtgggacgccggagcaccctctgcttcctagcagactctgtctcacccagagaagcagccattgtaccaagctatcttctggtggaggtctgctaaggatacacggaggtctcagcaaagggaagaaactatgtgatccaagggccaccctgctcctcggccctgcccatgttaactgaccattgcactcattctcagatctgtagccgtcttcctgtctggaagctggggcaaccaccaccagtcagcacttcagggtgacagcataatttgccctccttgtgccaggtacggtcacctggtttgccgcattcacattttcaggtggatgaccaagcggaggaactagaagagtctagtgaagcatccagagactggatctcctttcacatctggtttgataaactccgaatgaaggagacccccagcctcaggaaagcacctgtccttccaggagggacgggagagagcctgacccagtgtattaccacagcccttgttccacctctgagggagacagtgacagatgggaaggcagtgatgctcttggtcccagccagaagccaggggagatgggaggtacaccagagcagggcctgacaaggaagaaaataaggatgctttggacctcagtgtccttgtcttgaaaatgggaaggacaattcatgtccctgtctgccctggggataaatgagaggataaaagagaaagttcttcccagtttcccaggtggtcccagctagatcctgtgtccacggaagctgctggtgcccaggctgtgggtcttgttggaagaagcaggactggaacaaaggatgaaaaggaggttggcatggacataagaggagagcttgcactggaccaccgaagaccaccatccctggtctgggctctggcaccaggctctgccagtggcagctcagaggccacagggtgacattggccacacccccaccccacttccctggcctgggcctcgaaagatgaagcaactgaatttattcttaaatcagagaccaggaagggaaagtcagctggggccatggctaccttcttgggagagtgacccctgaacccagccaaggccacattcaagctcagtgtcaacactaggcatgaacctccaagggacctgtgggctggggcagaatggcttcagtgacaagactcaaaggaggcactagcattgtgctgctggactgggggaaggacttgcttgggaggagaactctacataggagctgggggcaggtggacctagatccaaccttcaacccctagtgaggggccaggcagaggacaaggcaacaactaagctaggtaaagttctggaaagtttccaagcccaggaggaacaaggaccactctggaaaaacattccaaagcccattgcatacctgtggtagagactaggggagtgattccagggataagacggacaaatgtgttccaggccccagctgatggtgggtgtggtcttcataatgagaggtggagctgagatttgggcctgggctgggaagaggagtacacagtccatctgatccacctctcttatggttccattggcaaaatcattcatcagtcgtcctatcttttcctggcgagcgctcacaatggcttcataagtgtttcaatacagtgtcccaggcagtcactacctatagattagagctgatgtgctggcctggggctctagagctgggcttcaggaagaatgtggtcagggccatcagggtggaacaaggtagctcaagaccttggaaagacaccctgagggcacaatcgtccttgcagtttaagatgacactttaaaaataaattctttcctaatgatggcttgagtcctgccactcaatgggagcatcagcggaacccgtagcatcttatttggaattgacattctctattgtaattttgttcctgtttatttttaagttttctttttgtttcactggaaaggaaagatgatgctctgttttaaacattaaaagtatacaagttgctttgttacaataaaactaaatatgtacacacaccaaaaaaaaaaaaaaatgatcaggatgcattcattcactcctgaaataaacatttac

SEQ ID NO: 2944 - DNA, 2560 bp, Homo sapiens
agtgagcgacacagagcgggccgccaccgccgagcagccctccggcagtctccgcgtccgttaagcccgcgggtcctccgcgaatcggcggtgggtccggcagccgaatgcagccccgcagcgagcgcccggccggcaggacgcagagcccggagcacggcagcccggggcccgggcccgaggcgccgccgcctccaccgccgcagccgccggcccccgaggcagagcgcacgcggccccggcaggctcggcccgcagcccccatggagggagccgtgcagctgctgagccgcgagggccacagcgtggcccacaactccaagcggcactaccacgatgccttcgtggccatgagccgcatgcgccagcgcggcctcctgtgcgacatcgtcctgcacgtggctgccaaggagatccgtgcgcacaaagtggtgctggcctcctgcagcccctacttccacgccatgttcacaaatgagatgagcgagagccgccagacccacgtgacgctgcacgacatcgaccctcaggccttggaccagctggtgcagtttgcctacacggctgagattgtggtgggcgagggcaatgtgcagactctgctcccagccgccagtctcctgcagctgaatggcgtccgagacgcttgctgcaagtttctactgagtcagctcgacccctccaactgcctgggtatccggggctttgccgatgcgcactcctgcagcgacctgctcaaggccgcccacaggtacgtgctgcagcacttcgtggacgtggccaagaccgaggagtttatgctgctgcccctgaaacaggttctggaactggtctctagcgacagcctgaacgtgccttcagaggaggaggtctaccgagccgtcctgagctgggtgaaacacgacgtggacgcccgcaggcagcatgtcccacggctcatgaagtgtgtgcggctgcccttgctgagccgcgacttcctgctgggccacgtggatgccgagagcctggtgaggcaccaccctgactgcaaggacctcctcatcgaggccctgaagttccacctgctgcctgagcagaggggcgtcctaggcaccagccgcacacgtccccggcgctgcgagggggccgggcctgtgctttttgctgtgggcggcgggagcctgtttgccatccacggagactgtgaggcctacgacacgcgcaccgaccgctggcacgtggtggcctccatgtccacgcgccgggcccgggtgggagtggctgcggtggggaaccggctctatgctgtgggcggctatgatgggacctcagacctggctaccgtggagtcctacgaccccgtgactaacacgtggcagccggaggtgtccatgggcacaaggcgaagctgcctgggtgtggccgccttgcatggactcctgtactcggccggcggctatgacggggcctcctgcctgaacagtgctgaacgctacgaccccctgaccggaacgtggacgtccgtcgctgccatgagcacccggaggcgctatgtgcgagtggccacgcttgatgggaacctgtatgctgtgggcggctacgacagctcctcacacctggccactgtggagaagtatgagccccaggtgaacgtgtggtcgcccgtggcgtccatgctgagccgacgcagctcagcgggcgtggccgtgctggagggtgccctgtacgtggcagggggcaacgacggcaccagctgcctcaactcggtagagagatacagtccaaaggctggagcctgggaaagcgtggcgcccatgaatatccgcaggagcacgcatgacctggtggccatggacggatggttgtacgccgtggggggtaacgacggtagctccagcctcaactccatcgagaagtacaacccgaggaccaacaagtgggtggccgcatcctgcatgttcacccggcgcagcagtgtgggtgtggcggtgctggagctgctcaatttcccgccgccatcctccccgacgctgtccgtgtcctccaccagcctctgacccacctaccaccagaggcctgcagcctcccacatgccttaaggggaccgtggcccccaccagggacgtcctgcgccatccgttcacgtctctgcatccattccttcatgtctttatttagttgtttatttatttagttatttatcttatttattgaggggtgaggagtgccacggctgcccgtttacacctttagcgtctggtcctcctgcgtgtcctcccctccactgcctgcatggggggcgcggggagtgaccaggcgggggcctcaccgccccagggccgttgcctgctcagaccttgcaggctgtggagcaagaggccctgggtctctccaagcagctgcagaccccagctcgaattttgcacatggcggggtcccgggaagggtggggagcagttgtccttcctgtcgtcgtctgccgtgtgccatctttcctggatcttgtagtgggtgcacacgcgtgcactgggaccccacacagcaatacgagtccaacttaataaacacatttctggggttc

SEQ ID NO: 2945 - DNA, 2207 bp, Homo sapiens
agtgagcgacacagagcgggccgccaccgccgagcagccctccggcagtctccgcgtccgttaagcccgcgggtcctccgcgaatcggcggtgggtccggcagccgaatgcagccccgcagcatgagatgagcgagagccgccagacccacgtgacgctgcacgacatcgaccctcaggccttggaccagctggtgcagtttgcctacacggctgagattgtggtgggcgagggcaatgtgcagactctgctcccagccgccagtctcctgcagctgaatggcgtccgagacgcttgctgcaagtttctactgagtcagctcgacccctccaactgcctgggtatccggggctttgccgatgcgcactcctgcagcgacctgctcaaggccgcccacaggtacgtgctgcagcacttcgtggacgtggccaagaccgaggagtttatgctgctgcccctgaaacaggttctggaactggtctctagcgacagcctgaacgtgccttcagaggaggaggtctaccgagccgtcctgagctgggtgaaacacgacgtggacgcccgcaggcagcatgtcccacggctcatgaagtgtgtgcggctgcccttgctgagccgcgacttcctgctgggccacgtggatgccgagagcctggtgaggcaccaccctgactgcaaggacctcctcatcgaggccctgaagttccacctgctgcctgagcagaggggcgtcctaggcaccagccgcacacgtccccggcgctgcgagggggccgggcctgtgctttttgctgtgggcggcgggagcctgtttgccatccacggagactgtgaggcctacgacacgcgcaccgaccgctggcacgtggtggcctccatgtccacgcgccgggcccgggtgggagtggctgcggtggggaaccggctctatgctgtgggcggctatgatgggacctcagacctggctaccgtggagtcctacgaccccgtgactaacacgtggcagccggaggtgtccatgggcacaaggcgaagctgcctgggtgtggccgccttgcatggactcctgtactcggccggcggctatgacggggcctcctgcctgaacagtgctgaacgctacgaccccctgaccggaacgtggacgtccgtcgctgccatgagcacccggaggcgctatgtgcgagtggccacgcttgatgggaacctgtatgctgtgggcggctacgacagctcctcacacctggccactgtggagaagtatgagccccaggtgaacgtgtggtcgcccgtggcgtccatgctgagccgacgcagctcagcgggcgtggccgtgctggagggtgccctgtacgtggcagggggcaacgacggcaccagctgcctcaactcggtagagagatacagtccaaaggctggagcctgggaaagcgtggcgcccatgaatatccgcaggagcacgcatgacctggtggccatggacggatggttgtacgccgtggggggtaacgacggtagctccagcctcaactccatcgagaagtacaacccgaggaccaacaagtgggtggccgcatcctgcatgttcacccggcgcagcagtgtgggtgtggcggtgctggagctgctcaatttcccgccgccatcctccccgacgctgtccgtgtcctccaccagcctctgacccacctaccaccagaggcctgcagcctcccacatgccttaaggggaccgtggcccccaccagggacgtcctgcgccatccgttcacgtctctgcatccattccttcatgtctttatttagttgtttatttatttagttatttatcttatttattgaggggtgaggagtgccacggctgcccgtttacacctttagcgtctggtcctcctgcgtgtcctcccctccactgcctgcatggggggcgcggggagtgaccaggcgggggcctcaccgccccagggccgttgcctgctcagaccttgcaggctgtggagcaagaggccctgggtctctccaagcagctgcagaccccagctcgaattttgcacatggcggggtcccgggaagggtggggagcagttgtccttcctgtcgtcgtctgccgtgtgccatctttcctggatcttgtagtgggtgcacacgcgtgcactgggaccccacacagcaatacgagtccaacttaataaacacatttctggggtt

SEQ ID NO: 2946 - DNA, 1950 bp, Homo sapiens
cgcgtccgttaagcccgcgggtcctccgcgaatcggcggtgggtccggcagccgaatgcagcccaccccaccccagtctttgtctttgactcccgaccccgttttgttcctgacacagccctgcccacaatccttagtgcctgctgtgtgtccccgagacctttctggatctgggccccccaggagcctcgtctgtggctcctgactctgctcggcccctcccagtatgaacactcagcccccacctgctaaccctccctcctaggcatcttcagggctccctgggtccacaggaccctccccagatctcaggtctgaggacccccactcccaggttctggaactggtctctagcgacagcctgaacgtgccttcagaggaggaggtctaccgagccgtcctgagctgggtgaaacacgacgtggacgcccgcaggcagcatgtcccacggctcatgaagtgtgtgcggctgcccttgctgagccgcgacttcctgctgggccacgtggatgccgagagcctggtgaggcaccaccctgactgcaaggacctcctcatcgaggccctgaagttccacctgctgcctgagcagaggggcgtcctaggcaccagccgcacacgtccccggcgctgcgagggggccgggcctgtgctttttgctgtgggcggcgggagcctgtttgccatccacggagactgtgaggcctacgacacgcgcaccgaccgctggcacgtggtggcctccatgtccacgcgccgggcccgggtgggagtggctgcggtggggaaccggctctatgctgtgggcggctatgatgggacctcagacctggctaccgtggagtcctacgaccccgtgactaacacgtggcagccggaggtgtccatgggcacaaggcgaagctgcctgggtgtggccgccttgcatggactcctgtactcggccggcggctatgacggggcctcctgcctgaacagtgctgaacgctacgaccccctgaccggaacgtggacgtccgtcgctgccatgagcacccggaggcgctatgtgcgagtggccacgcttgatgggaacctgtatgctgtgggcggctacgacagctcctcacacctggccactgtggagaagtgaacgtgtggtcgcccgtggcgtccatgctgagccgacgcagctcagcgggcgtggccgtgctggagggtgccctgtacgtggcagggggcaacgacggcaccagctgcctcaactcggtagagagatacagtccaaaggctggagcctgggaaagcgtggcgcccatgaatatccgcaggagcacgcatgacctggtggccatggacggatggttgtacgccgtggggggtaacgacggtagctccagcctcaactccatcgagaagtacaacccgaggaccaacaagtgggtggccgcatcctgcatgttcacccggcgcagcagtgtgggtgtggcggtgctggagctgctcaatttcccgccgccatcctccccgacgctgtccgtgtcctccaccagcctctgacccacctaccaccagaggcctgcagcctcccacatgccttaaggggaccgtggcccccaccagggacgtcctgcgccatccgttcacgtctctgcatccattccttcatgtctttatttagttgtttatttatttagttatttatcttatttattgaggggtgaggagtgccacggctgcccgtttacacctttagcgtctggtcctcctgcgtgtcctcccctccactgcctgcatggggggcgcggggagtgaccaggcgggggcctcaccgccccagggccgttgcctgctcagaccttgcaggctgtggagcaagaggccctgggtctctccaagcagctgcagaccccagctcgaattttgcacatggcggggtcccgggaagggtggggagcagttgtccttcct

SEQ ID NO: 2947 - DNA, 552 bp, Homo sapiens
ggagtagcaagtccgcggtaagcgctgacgcatgcgcatagctaaccgcacccggttcagctcgcctttcttggccagaggcgccggttggactcacgggcggggcatgatggtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgta

SEQ ID NO: 2948 - DNA, 872 bp, Homo sapiens
acagcggccctgcggctggcgcggcggacgggatgaggcgctgcagtctctgcgctttcgacgccgcccgggggcccaggcggctgatgcgtgtgggcctcgcgctgatcttggtgggccacgtgaacctgctgctgggggccgtgctgcatggcaccgtcctgcggcacgtggccaatccccgcggcgctgtcacgccggagtacaccgtagccaatgtcatctctgtcggctcggggctgctgagcgtttccgtgggacttgtggccctcctggcgtccaggaaccttcttcgccctccactgcactgggtcctgctggcactagctctggtgaacctgctcttgtccgttgcctgctccctgggcctccttcttgctgtgtcactcactgtggccaacggtggccgccgccttattgctgactgccacccaggactgctggatcctctggtaccactggatgaggggccgggacatactgactgcccctttgaccccacaagaatctatgatacagccttggctctctggatcccttctttgctcatgtctgcaggggaggctgctctatctggttactgctgtgtggctgcactcactctacgtggagttgggccctgcaggaaggacggacttcaggggcagctagaggaaatgacagagcttgaatctcctaaatgtaaaaggcaggaaaatgagcagctactggatcaaaatcaagaaatccgggcatcacagagaagttgggtttaggacagcaggtgctgttccgagactcagtcctaaagggttttttttcccactaagcaaggggccctgacctcgggatgagataacaaattgtaataaagtaacttctcttttcttcta

SEQ ID NO: 2949 - DNA, 942 bp, Homo sapiens
ttccgggccctggcgtctcgtctccttaccctggggctacccttgccccgtcctactgcccgcggttaacccgccgcgagccgcctctcccctccccgcccgactcaaccctgccctcccccgtgctttgcagacgccgcccgggggcccaggcggctgatgcgtgtgggcctcgcgctgatcttggtgggccacgtgaacctgctgctgggggccgtgctgcatggcaccgtcctgcggcacgtggccaatccccgcggcgctgtcacgccggagtacaccgtagccaatgtcatctctgtcggctcggggctgctgagcgtttccgtgggacttgtggccctcctggcgtccaggaaccttcttcgccctccactgcactgggtcctgctggcactagctctggtgaacctgctcttgtccgttgcctgctccctgggcctccttcttgctgtgtcactcactgtggccaacggtggccgccgccttattgctgactgccacccaggactgctggatcctctggtaccactggatgaggggccgggacatactgactgcccctttgaccccacaagaatctatgatacagccttggctctctggatcccttctttgctcatgtctgcaggggaggctgctctatctggttactgctgtgtggctgcactcactctacgtggagttgggccctgcaggaaggacggacttcaggggcagctagaggaaatgacagagcttgaatctcctaaatgtaaaaggcaggaaaatgagcagctactggatcaaaatcaagaaatccgggcatcacagagaagttgggtttaggacaggtgctgttccgagactcagtcctaaagggttttttttcccactaagcaaggggccctgacctcgggatgagataacaaattgtaataaagtaacttctcttttcttcta

SEQ ID NO: 2950 - DNA, 373 bp, Homo sapiens
gctctatctggttactgctgtgtggctgcactcactctacgtggagttgggccctgcaggaaggacggacttcaggggcagctagaggaaatgacagagcttgaatctcctaaatgtaaaaggcaggaaaatgagcagctactggatcaaaatcaagaaatccgggcatcacagagaagttgggtttaggacaggtagtagctgggtgtgacgcaagagtgaaacagaaagcctggcagccacggtttcctgggattaaagtcaaagcattatgaatatggcactaaagtgactgagctaccagaccaatgatcctgtaaggcagccacagaactaaaaaacaacaattattattaaactgctctggattctc

SEQ ID NO: 2951 - DNA, 956 bp, Homo sapiens
gggccgggcccaggtacagcggccctgcggctggcgcggcggacgggatgaggcgctgcagtctctgcgctttcgacgccgcccgggggcccaggcggctgatgcgtgtgggcctcgcgctgatcttggtgggccacgtgaacctgctgctgggggccgtgctgcatggcaccgtcctgcggcacgtggccaatccccgcggcgctgtcacgccggagtacaccgtagccaatgtcatctctgtcggctcggggctgctgagcgtttccgtgggacttgtggccctcctggcgtccaggaaccttcttcgccctccactgcactgggtcctgctggcactagctctggtgaacctgctcttgtccgttgcctgctccctgggcctccttcttgctgtgtcactcactgtggccaacggtggccgccgccttattgctgactgccacccaggactgctggatcctctggtaccactggatgaggggccgggacatactgactgcccctttgaccccacaagaatctatgatacagccttggctctctggatcccttctttgctcatgtctgcaggggaggctgctctatctggttactgctgtgtggctgcactcactctacgtggagttgggccctgcaggaaggacggacttcaggggcagctagaggaaatgacagagcttgaatctcctaaatgtaaaaggcaggaaaatgagcagctactggatcaaaatcaagaaatccgggcatcacagagaagttgggtttaggacaggtagtagctgggtgtgacgcaagagtgaaacagaaagcctggcagccacggtttcctgggattaaagtcaaagcattatgaatatggcactaaagtgactgagctaccagaccaatgatcctgtaaggcagccacagaactaaaaaacaacaattattattaaactgctctggattctcaa

SEQ ID NO: 2952 - DNA, 6664 bp, Homo sapiens
ggtgcatgccgggacggcggtgggtggtgcatgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatcttgtggcgccatgttgacaagggcacggcagaaggggctgtggatgccatgctgctgcacggacaggatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacagactgccctagtgagctttgccaccactggggagaagacggtggctgcagtcatggcctgtcggaatgaagtgcagaaaagtagcagttctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgacactgtttaagtcctcttttgtgtcttagaagatcattttgaggctattttcacattagaggggataaaagcagtgaagacatggagtaagtgtattttattttagtaaggaaaggtcagtttaatcatatatgggttggttaggttatctaaaaatttgtcatctttctatggtcatatgctgatggtagattatggcagagaaggaagaggaaatgacaaccattttattaattgtcagtttgatattgagtgactgaatgtctaagaatctccagaaaaaaacaggcatctatcatcctgacccaaggcatattttaacataacctgggagaagagagttaagtacaagttaaaaaaaattctgccctagttttgagaaagcctggctggaattctgactgtcttacatacatatgtgcaaggttagcctgcaagattctagtttttatttaccagtgtgccagaatctgaaacaagctactgggagggaaggtatttgtcctttagtaaaattccctgtatttcagctgtaatcaaagttacctcaaagcaggtgctttttttttttttgagacagaatctcactctgttgcccaggctggagtgcagtggcacgatcttggctcacggcaacctccacctcacaagcagctgggactataggcatgtgccaccacgctcagctaattttttgtatttttagtagagacggggtttcattgtgttggccaggctggtctcgaactcctggcctcaagtgatctgctggccttggcctcccaaagtgctgggattacaggtgtgagccaccgagcttggccaagtgcttaaaatagttaatgctaatgccacagtccaatttaaatcttttcttagttctcaactttccttaatcttaaagcagcattcggttctgagcagctacactcagtctccactaatggctgctgagactatgtttcctctctcaattctctgatctatttgctttcttgtcattccttgttttttgtgtgtattccttgacttacctcttctcctgtcttcattaattaggttaattttggggccccatggtgtttcacgtaaaaagatttggctgggcgtgatggctcatgcctataatcccagcactttgggaggccatagtggaggatctcttgagcccaggagttccagaccagcctgggcaacatagcaagactctatctacaaaaaataaaaaaaaattagccgggcctggtggcatgtgcctgtggtcctagctactcaggaggctgaggtaggaggatcacttgagcctgggaggtcgaggctgcagtgagccatgaacatgctactgcattccagcctgggcaacagagtgagaccctggctcaaaaacaaaaacaaaaactagtttgttttagtattcattaattacgtatatgagcactggtagtctagtgtttgttcttgtatacagtgttttcttaaatgagatgatgctatttaattctgttacttgttttttcaactaatggatcttttaaagttttttatttaaattttttgtgggtacatattaggtacatatacttatggggtacatgagatgtttttataaaggctcagctaatgtatcttgaatatcatgtattcataaagatgactgaaatagtttctggaacaaagtctgatagaaaaaatactcaattcctaatttaagtgttagagactttaatgtaagctatctaatctgaactagtttcattatttgtgtgtgggtacatgttatgtgctccgtaaggcatctttcaatttgaaaatttcataattgtaatttcactgcctttataaattgctttttttttggaggcagggtctctgtcacccaggctggagagcagtggcacagtcatagctcactgcagcctcgaacacctgggctgaagtgatcctccctccttagcctcccaaagtgccgggattacaggcatgagctactgcacctggcccataaattgtcatacttttaaagagcctattacacaaagtatcatcagaatcatcccaagactcatttcctgattcctaattatttaaaattttgcttttaggcgaggcatggtggctcaagcctataatcccagcactttgggaggccaaggcaggcagatcatttgaggtcaggagtttaagaccagcctggccaacatggtgaaacctgaaaccccatctctaccaaaaaaataaaaaaatttagccaggtgtggtggtgcatgcctgtaatcccagctacttgggaggctgaggcaggagaatcgaacccaggaggcaaaggctgcagtaagccgagatcatgcctctgcactccagtctgggcaacacagtgagaccctgtctcaaaaataaataaaatgaaaaaattgcttttaaatcat

SEQ ID NO: 2953 - DNA, 5461 bp, Homo sapiens
ctgaactttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacatcgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatgatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagaggggccctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaatacctgtggctggtctgtaaggccactccagggtctgcccacccccggcggtggctggcaaagggaggcctaaaccttcctccatctacgcgggtgggtccctcaggtctggctcaggcgagacccctagggtcaggggtccccatgtcacagaggcaaacacacagcccagtcacgtggaatggtgttttcattggtgttagttgggggaagaggttaatggttacagagccagggcctgggccaatggggtcaggctctccctgccctcaggtgggcagtcggggctcctgctgtggtccgaagcccctcccccattgtgtcctctcaggcagttgatagaataaattccatttaaaat

SEQ ID NO: 2954 - DNA, 5388 bp, Homo sapiens
agtgacgcgggcgctgcagccgtcgctaccgccgcgttctattctccgaagccggcgaccgccccacctcctccctccctcccgcccgcttcctctgcccacagcgccggccagagcgagctagacaagggcacgcggggcctcgcctagacccgagaagactgcgggcgcgcgcaagcggcggcgtggaagctgtgagcgcccccatcccggaggtctccgccggctcccgggtgaatcagctcccggccgactttaggattcttctggattttaaattttttctttttaaaaaaacttggacggataaaagatgtgccatggcaggatagcaccaaagagcacctcagtgtttgccgtggcctccgtgggacatggagtgttccttccgctagtgatcctttgcaccctgcttggagacggacttgcttccgtgtgccccctaccaccggagccagagaatggtggctacatctgccacccccggccctgcagagaccccctgacagcaggcagtgtcatcgaatacctgtgtgctgaaggctacatgttgaagggcgattacaaatacctgacgtgtaagaatggcgagtggaaaccagccatggagattagctgccgtctcaacgaggataaagacacccacacatcacttggggtccccacgctgtctatagtggcttctactgccagctccgtggcgctcattctcctcctcgtggtgctgtttgtgctgctgcagccaaagctgaagtctttccatcatagcaggcgtgaccagggggtatctggggaccaggtctccatcatggtggatggagtccaggttgcactaccatcatacgaggaggctgtatatggcagttctggtcactgtgtgccacctgctgaccccagagtacagattgtgctgtcagaagggtctgggcccagtgggaggagcgtgccaagggagcaacagctgccggaccaaggggcctgctcctctgcaggtggagaagatgaggccccaggccagtctggactatgtgaagcctggggctctcgggcctcagagactgtgatggtgcatcaggcaaccacctcttcctgggtggccggctcagggaaccgccaactggcacacaaagaaactgcagattcagagaacagtgacatacaaagccttttatccctcacgtcagaggagtacacagatgatattccactgttgaaagaagcatgagggcagcggccagcctttcctctctgcgaggttctctcagcccttcctccctctccctgtgggattgagcaccctgtactctccagccaccttacctggatacctgagctgccacctgtgtatctgtgtatctctgagggccctataggcccaccttgctggaaactcaaggaagattctcgccatctgcctgttggacagctggaggagctggctctttgcctggccccgccttcccatctgtcagagacatatttgaatgtgctggatcaaaccctcccttttcctaagcctctgggtcccctccagccagctctttggcggcagcccccaccagctcctgtgggcctgagtgctgctgtgtttacttgtgcctttcccccaccctgtccagtttccctgtcatgcagacttgttgctgtccacaagccttagtggctgcactgctgccccctgccacacagggggccgggcctgggtctgtcctgtttcctttgagggttgcccctactgccctttgcaggaacagatccaggtgtgagagctcttgagtcaagagtggcagaagtggctctaattggggtgagagtgtagtccctgggcttgccctgggttgaccctggtggcatatttccttggctgaggatggaagatttggagaatcatgtccatgctggcccaggacccagccatctggcccaaaggcacaagctcctggccctgttgagttgagagtttccaagaagcatccagaagatcccaagggagagaaggaaaatggctgataatgattgtcttcctaatatgcaagttctcacttcctacttccagcatcggccttcctggccttgtcttttttttgtttccctggagtataatgggaagttgcatgctgcctcctgggttttatcccagatagctctggctttcttgctgcccacaggggcctggggcaggaaggagacttgctgagatgccatggagtgcccatctggtcactggcagtctgggcaggttgcccctttctgggtttgtggtgacggaggggaggccgagaggcacagaccaagtccccgggtggctgcaggcagctccagcccggtcctgaggatcctcctcaccatggtcacgtgccttagtaactgtgcccaggaagtggcctgctgcttgctgtgctgctgcttttcctacttctgcccttccctgccacccctcgcatgtcacagctgacaagcaattccttgtcttccctggccccctgggggaagggctgagaaacagtccgtgtgcaccccaaccttaatggcctgaggtgggcagaggggtgtggagcagcctggagtacagggccctgggggaggagcccactgatgaggggcgctctcccatagccatgtgttgaatgctaactaggctggggtggacgaactctgccaactgctgtcatcttagaagatagatgcagcagtaaggaatgtttgttttgcttttttctgaaattttctgaagcactgtggctgggaaacttcgaagcggaccctgtgctgcatgtctgctcctcccctgagcctgtctgcttgggggtggtaaaaataaaaatcccagtttattttcagtaccttacctaacagggttggctccaggcgtgggtggcctagaagatgaggggagtggtcttctcccagccttttaccctcttgcctcctgcctccgcgcttacacacgcactttaccacccggtcattccctggcctcttgctgccacttgtagtcttccttccttcctctcagggtaagggcagtgcctgctgtgcctgttggccactcccacacttcccctcccccaggagccctcatctgctgtgctgagtccaggaaagcatagttaggtagggagctggttggagaaggtgctagaactagaaggcagatgagactagcatgggcccacctggagggctgtccctaatggccccagtcgccttacctcacccacagcagtgcccttgtcttcctccaaaacagaaagcagtgacaaaagggggaggggtggtaatctgaagtctcactgctgagccttcagcttttatttttcactgtttcaaaacccgcattctattctagaatggtttttaaaatggaagatcttacctttttctatcttgttactctggggttttgtccccctaagagattgcactttttgtttggggtttattcagctgcatagatgaccagcttgatccctggtgaaatgaaaagccttccttctcctgaagcctctttccgccctgccctccactaacaacactgaggagcacaagcccaggcttgcccacctggtaggaaaggaagaaattagaacaatgggagccttggctcccctctcgtctcctcccctccttcttgtcactggctttgatgaggcccacttcccagaggctcctgggcctgtgagtgcaggagctcattctcccctcactgctgaagtctgtgacagcttcttcctccagttatgtctttcttccaaagcaatttcttaaccatcagccatgtgctgctatttctagggcttctgggctttgtcccttactgagagattagggactccacagctgccttgaggtagggcctggctgagagacaagggtagcagcaggtggcaggctgttaaaagacaggctgcctgaggagcctggagcaggtggaaacaggtggaagaaaccggccacagccctgctttaccgggctcacctctagggcattccagcaagaggctgatgcaggagaatggccagcaccaaaggacatttaaaagagtttttgggtttttttgtttgtttgttgttggtgtttgtttttttttttttttttttggcacacttgagctgactcagtgcaggtttaatatcctggtgacttgcagtcacattctaatgactttcaagggccagaatatggtgaaaatcacttaaaatatccgtcccttccatgccttagtttagcaggtaggctctatcttttgccatttctgtattttatgtgctgtgttcccgtttcactgggtatgaactgtgaaatcgactgaatcctggccactttatgagtttgtttggttttataaggcatttcaatgtacattctataaatacaagcactccatttgcaaacagatcttaagctaatattttctttcccattcatcttgccctccccctcctcccgccagctttaaagttcagtggagaagccagatggcaattcagacaaaggtatactcttcctgcttcatgggtggtggcacgggaatagatagcccttagccctttccctcccagtcccagctgagccctcagaccacttgcttcccacataacaatgtcgcctccatttccgaggaacatccttgcgtagagaatgaaatatgctgcaatcatttctgcatccttactcctcacccccaaagaaaaaaaaaaggcctagcagggaagcagcatgcaggcttcacagcttaatgccaaggacagcgagtgaggctgggagcttctcttgggcctgctgggtctgtcagctctcggaatagggacagtccttactggtgccccaaggtgggacttggagaatattttgcttggcatatgtttggtctgaatggtgtagttgctggttccctagagaggaaaaggtggcaggcccagctttgctgggaaatggctcttaatttccagttgaaaccctagtagaattgtgaatgaaaacctcaaggttgagcccctctgccaagcagcagagctagtagaaggggatgcaggggcaaagcactcagttgccaagcaaggaggagagatgtacgtgggctgtgtggcagtccccacaccctgccctggcttcttcaggttatcgcaccactatggaatcctttgcagaatggtactcatataatggtttaaaacaacacattcataattgactctgtgcaggatgtcactcaatcagtttgggtttgctttattttattttatatatatattttttggtatcctgtacattgcagtgggtgtgaagatagtattttaatatttgtacaaagtttaatttaattttaattgttctatgtatataactgcatttctaaataattaaaaaaaagttcttatgaaggc

SEQ ID NO: 2955 - DNA, 5456 bp, Homo sapiens
atagcccggaagcggaaactccttggggaaagggcaatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcgggatcctggggcgtcctttggcagtcgattgcaccctgcactagagagaagtccaggaatgatatattcttgggctgtatttctctaccctggagttcatccagttcatcccagaaacactgacctgattactgtgacaaagtctgatggatagaccctttctgttgaccttgtggcgtttttctttcatgtggaagttggaagacaaggtgaaaggggccaaaagttacctgctttggtgaataggagtgctctacttggttctcagaacatgggccctcgtttaaagctgcagctgtgatcctcggctgtctgttggcattgacgggacctgatgttttacgttattggtggaatcacagtgtctgtggttgcattcttcttcacaattaagttcctctttgagcttgccgcacgtgtagtcagcttcctccagaatgaggaccgcgagcgccgaggggaccggactatttatgactacgtgcggggaaattacctggatccccggtcttgcaaagtctcctgggattggaaggacccctatgaggtgggccacagcatggccttccgagtgcatttattctataagaacgggcagcctttccctgcacatcggcctgtgggactaagagttcacatctctcatgtcgagctagcagtggaaattccagtgacccaggaagtccttcaggagcccaattccaacgtagtaaaagtggccttcactgtgcgcaaggctgggcgttatgaaatcacagtgaagcttggtggattaaatgtggcatatagtccctactacaaaatttttcaacctggaatggtggttccttctaagaccaaaattgtgtgccacttttctactcttgtattgacctgtgggcagccgcacacccttcaaatagtaccccgagatgagtatgataatcccaccaacaattccatgtccttgagagatgagcacaattacaccttgtccattcatgagctcggccctcaagaagaagagagtactggtgtctcatttgagaaatcagtaacatccaacaggcagactttccaggtgttcttgcgactcaccctgcattctcgaggctgcttccatgcttgcatttcataccaaaatcagccaatcaataatggtgaatttgacattattgtcctaagtgaggatgagaagaatatcgtcgaacgcaatgtgtccacttcaggcgtgagcatttactttgaggcttatctttataatgctaccaactgtagcagcactccatggcacctgccacccatgcacatgacctcttcccagcgccggccatccactgctgttgacgaggaagatgaagactcgccctctgagtgccacacccctgagaaggtgaagaaaccgaagaaggtgtactgctatgtgtcaccaaagcaattctcagtgaaggagttctacctgaagatcatcccctggcgcctttacaccttccgagtgtgtccaggaacaaaattttcataccttggtcctgaccctgtccataagctgctcacactggtggtggatgatggcattcaacctcctgtggagctcagctgtaaggagaggaacattctagcagccacttttatccgctccctgcataagaacataggaggctctgagacctttcaggacaaggtgaactttttccagcgagagcttcggcaggtacatatgaaaagaccacattccaaagtcaccctgaaggtcagcagacatgccttgttggaatcgtctctgaaagccactcggaatttctccatctcagattggagcaagaactttgaggttgttttccaggatgaagaagctctggactggggagggcctcgccgggaatggtttgagctaatctgcaaagcactatttgataccaccaatcagctcttcacccggttcagtgacaacaaccaagcattagtgcatcccaaccctaatcgccccgctcatctgcgcctgaaaatgtatgagtttgcgggacggctcgtgggcaagtgtctctatgagtcctctctaggaggagcctacaagcagttggtccgagctcgcttcacccgctctttcctggcccaaatcataggactgcgtatgcattacaagtactttgaaacagatgacccagaattctacaaatctaaagtttgttttatcctcaacaatgacatgagtgagatggagctggtctttgcagaagagaaatataataaatcaggtcaattggataaggttgtagaactcatgacaggtggagctcaaactccagtcaccaatgcgaataaaatcttctatttaaatttgctggcccaatatcggctggccagtcaagtgaaagaggaggtggaacatttcctaaaaggcctgaatgaattggtccctgagaaccttttggctatttttgatgagaatgagcttgagctgctgatgtgtgggactggagacatcagtgtgtctgacttcaaagcccatgcagtagttgttggtggctcatggcatttcagagaaaaggtcatgaggtggttttggactgtggtttccagtctgacccaggaggagttggctcggctacttcagttcacaacaggctcctctcagctaccacctggaggctttgccgccctctgtccctcatttcagattattgccgctccgacccatagcacgctgcctactgcacacacatgttttaaccagctgtgcctccctacatatgactcctatgaagaggtgcacaggatgctgcagctggccatcagcgagggttgcgagggctttggcatgctctgaccactctcctgtcatccagttggctcccatgctctctggagcttctgggcgcaagttacagacatcataaccactgatcctaacacacataaccatcagccagaagatgccgcatgctcccctgtgtctggaggattttgtcacctacaagccttgtctttacctcacctgctccctgcccatatctaccacaggccactttggcatggtatgtaagctgagctcttcattctgtcatgagaagaggaccatgctgctatcatttatttggtcctttgaagatctcagtagctgagggagatggcacacggggctcagccctgttgggaaactggtgtggagacccttaaatccacactgtgctccaaaactccctctgctgatactccttggagacaccctctttggccctcactacttgaccagactggtacttgagtccttctcatgggtggggtgattgcctcttctcatcaggagccaggagagagggggacagataggaggtggcccataggagcagtcccgctgcacaatggtaggcataggccatggcactggactgcctctaaggactgctaaaaagaatatttttttgtggtgtcagaactggaaaaagcactttcccttcgggcatttctggaaatgattattaatccacaaagaagaactctgtaagctttttcttgaattgtagccagtgagaaaagcagatagactgaagaatatgaaggatagctgagctgtagcctccagagtggggcatgcctaggcatatggctggcttggagactactgatgcttttccctgagtttgttattggcactgaagtatggccggcttgggccactgacttccccattatgtagtctgctaaaagctggggatcctttagcattctactgaagaaaattttgtagcaaaagattagaacagtaagaatagtatgccagcaatccctgattctctctctgcttggtgttctctggcagcactaagacaaaggaacagggactaggagtttacgtgcttatcacaggtccttggcgtcaggacactagggatgaacatggaggtgatatgttacacagtaaacacctgccaacccctgtactcccctttgctccatcagttatcaggaaggagaactaaggagggaggaagcttattaggttcactgttgaatgatgattgaagagtacctgctgctgtatcttggaagatgacaacatcctttttcattactgtttgattgaaaataatttcaagattcaaaatctcattgacttcccaaatttgtgtttttaagaaggctttgctgcaagctaccattcccaatggggcagtcaactctgagaatattacaagccatctttattgccaaaaccagcaagtacacagagtcctgaaacaaggcaggactttggcaatgccttggcctcctggaagcatgtctgagccctcctgttcgcagggatcatgaggaacaagccctcctgagctgctacagttcctgcctgacctcagtctttcgcagtcatcatttgtcctttcttggcacatgggtgctgacctcactcatccttggggtccgggatccagcatcagggtctctataccccaggatcctccatgccacatggtcactgctctcctcagggaccaggacaaggtgctgctgcttgcccaaatgttttcccatgggatatgtaccggaaggtttatcaccaccctgggaaacataatgctgccccttgggcccagaaaggggtttccagctgggggcacgtggactggttctgctgtttttggcagtcgcttttctgaattctcccctccggcagccttccagagactgatcctggagattgagttgattgtcttggctagacctgtcattttaagctctagtcatagcactttttcagagcatcttaggcaccattgcaacccaaccagggaagctgcatccctgtggtggtccttaggcaccagtctttgttaaacaaaaccctttggcactattgtggttttctattctctgtctgaactctattcaaaagtatctttgctctcttgggccttttcttttactgttttgttttttttttttctaatcctgctttcatactagccagtgtggggaaaaggtacaatatgtcaaagagatgagagagtgttatttcttgggcaattttctattagtgtttcttattttggccagttcttttatttatgtccttgtgacccaggtacttggggggccagctacccttctggccttttagcgtctttgaaggagaccagacatgagtgaatacctaggagagtgtcagcatgtttctggaaaattggcagagaccaagccctgctgcagattcgtcaggccaggtgaaagggccaggcagttgcagctgatgatgtaaatattttgtacagtagataaataaatgtttaaaagaactaa

SEQ ID NO: 2956 - DNA, 4789 bp, Homo sapiens
aggaggcggtgtttccggccgccgtcgctgtccagggaggctgaggcgagaggtagctgtccgggtggggagcccgcactaccttcttcctcttcctcctcctcctccgggtgaggggagcgaaggttgggggtccccgagcccatggaccaggaggaggcggaggccgccgagagccggggccccgctatgtggccctgagccccgtgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaaggagaaacctacacctacgactggcagctgattactcatcctagagactacagtggagaaatggaagggaaacattcccagatcctcaaactatcgaagctcactccaggcctgtatgaattcaaagtgattgtagagggtcaaaatgcccatggggaaggctatgtgaacgtgacagtcaagccagagccccgtaagaatcggccccccattgctattgtgtcacctcagttccaggagatctctttgccaaccacttctacagtcattgatggcagtcaaagcactgatgatgataaaatcgttcagtaccattgggaagaacttaaggggcctctaagagaagagaagatttctgaagatacagccatattaaaactaagtaaactcgtccctgggaactacactttcagcttgactgtagtagactctgatggagctaccaactctactactgcaaacctgacagtgaacaaagctgtggattacccccctgtggccaacgcaggccccaaccaagtgatcaccctgccccaaaactccatcaccctctttgggaaccagagcactgatgatcatggcatcaccagctatgagtggtcactcagcccaagcagcaaagggaaagtggtggagatgcagggtgttagaacaccaaccttacagctctctgcgatgcaagaaggagactacacttaccagctcacagtgactgacacaataggacagcaggccactgctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtcaaagaagaaataaacaaaccacctatagccaagataactgggaatgtggtgattaccctacccacgagcacagcagagctggatggctctaagtcctcagatgacaagggaatagtcagctacctctggactcgagatgaggggagcccagcagcaggggaggtgttaaatcactctgaccatcaccctatcctttttctttcaaacctggttgagggaacctacacttttcacctgaaagtgaccgatgcaaagggtgagagtgacacagaccggaccactgtggaggtgaaacctgatcccaggaaaaacaacctggtggagatcatcttggatatcaacgtcagtcagctaactgagaggctgaaggggatgttcatccgccagattggggtcctcctgggggtgctggattccgacatcattgtgcaaaagattcagccgtacacggagcagagcaccaaaatggtattttttgttcaaaacgagcctccccaccagatcttcaaaggccatgaggtggcagcgatgctcaagagtgagctgcggaagcaaaaggcagactttttgatattcagagccttggaagtcaacactgtcacatgtcagctgaactgttccgaccatggccactgtgactcgttcaccaaacgctgtatctgtgaccctttttggatggagaatttcatcaaggtgcagctgagggatggagacagcaactgtgagtggagcgtgttatatgttatcattgctacctttgtcattgttgttgccttgggaatcctgtcttggactgtgatctgttgttgtaagaggcaaaaaggaaaacccaagaggaaaagcaagtacaagatcctggatgccacggatcaggaaagcctggagctgaagccaacctcccgagcaggcatcaaacagaaaggccttttgctaagtagcagcctgatgcactccgagtcagagctggacagcgatgatgccatctttacatggccagaccgagagaagggcaaactcctgcatggtcagaatggctctgtacccaacgggcagacccctctgaaggccaggagcccgcgggaggagatcctgtagccacctggtctgtctcctcagggcagggcccagcacactgcccggccagtcctcctacctcccgagtctgcgggcagctgctgtcccagcatctgctggtcatttcgccctgacagtcccaaccagaacccctgggacttgaatccagagacgtcctccaggaacccctcaacgaagctgtgaatgaagaggtttcctctttaaacctgtctggtgggcccccagatatcctcacctcagggcctcctttttttgcaaactcctcccctcccccgagggcagacccagccagctgctaagctctgcagctccccagtggacagtgtcattgtgcccagagtgctgcaaggtgaggcctgctgtgctgcccgcacacctgagtgcaaaaccaagcactgtgggcatggtgtttccctctctggggtagagtacgccctctcgctgggcaaagaggaagtggcacccctcccctcaccacagatgctgagatggtagcatagaaatgatggccgggcgcggtggctcacgcctgtaatcccagcactttgggaggccgaggcgggcggatcatgaggtcaggagatcaagaccaccctggctaacacggtgaaaccccatctctactaaaaataaaaaaaaaaattagccgggtttggtggcgtatgcctgtaatcccagctactcgggaggctgaggcaggagaattgcttaaacctgggaggtggaggctgcagtgagccaagatcgtgccactgcactccagcctgagtgacagagcaagactccgtcaaaaaaaaaaaaaaaaaaaaagaaatgatatctggcccccccttaacactggagccccactcccttctcccatccggcccgagattagggaggattgactgtgtcagggatggcgggtggcctctctcgctgccagggcccttgtcagagcagccaggctggacagacggcctccctcctctccatctgaccggcacctgctgcttcggggcttaggccaccgctccctgtccccagaggagatagccccagatggactggaatgttgtggcatgagagcgcatgtgtgcgatggccccgctgtggtcccctctctgtccctccatctgtatgtgttctgtgtcccttgcatgtgtgcgtgttagagtgagcgcgtatgcatcaactcattgggctcttggctgctcacaaggcaaatttgacttggaaagactttcatctccttggaaccaagacttcctgagtccccctcaccctggccctgttccaccatggttatctgggtattggggaatggaaactttgggggagtgactttttaaagagacacttataatttctactactgcactactgtccattgtgggatgattaaacatggtatttaactgtgca

SEQ ID NO: 2957 - DNA, 5017 bp, Homo sapiens
agcgagctagcggcgagcgcggcgagcaacggagaggagcgcgagcagcagcatggcggggctccgacgcccgcagcccggctgctactgccgcaccgcggcggccgtgaacctcctgctgggcgtcttccaggtcctgctgccctgctgtcgcccgggaggggctcagggacaagcgattgagccgttgccgaacgtggtggagctgtggcaggcagaagaaggggaactcctgctgcccactcagggtgattctgaagagggtctggaggagccttctcaagaacagagcttctcggacaaactatttagtggaaaaggcttacattttcagccatcagttttagattttggaatacagttcctgggacatcctgtagcaaagattctccatgcttacaaccctagtagggacagcgaggttgtggtgaattcagtgtttgcagctgctggacatttccatgtaccgccagttccctgcagggtaattccagcaatggggaaaacttccttcagaattattttcttacctactgaagaaggaagcattgaaagttccttatttattaatacctcttcgtatggagtcctttcctatcatgtatctggaattggcactcgtagaatctctacagaagggtctgcaaagcagctaccaaatgcttattttctgcttccaaaggtccagagcattcagctgtctcaaatgcaggcagaaaccactaatactagcctcttgcaggtgcaactggaatgcagtttacataataaagtgtgtcagcaattaaagggttgttatctggaatctgatgatgttttgcgtctacaaatgagcataatggtaacaatggaaaacttttcaaaagaatttgaagaaaacacacaacatttgttagatcatctctctattgtttacgtagctacagatgaatctgagacctcagatgattcagcagtaaatatgtatatattacattcaggaaacagccttatatggatacaggatatacgccatttctcacagagagatgctctgtctctgcagtttgaaccagtactactacctacttctacaacaaactttacaaaaattgcttcttttacctgcaaagctacatcatgtgacagtggaattatagaagatgtgaagaaaacaacacacactccaacactaaaagcatgcctcttctcttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggaagggagtctgggttttgaagtgatagcacattgtggcatgcattatttcatgggaaaatcaaaagcaggaaatcctaattggaatgggagcctttctctggatcaatctacctggaatgtggattctgaacttgcaaataaattgtatgaaagatggaagaaatataaaaatggtgacgtctgcaagaggaatgttttgggaacaactcgatttgctcacttgaagaaatccaaggagtcagagtcctttgttttctttttgcctcgtttgatcgcagagcctggcctcatgttaaacttcagcgcaactgcccttaggagcaggatgatcaagtactttgtggtgcagaacccgtcctcttggccggtctccttgcagctcctgcctctctccttgtaccctaaacccgaagccctagtgcacctgctccacagatggtttggcactgatatgcagatgattaatttcacaactggtgaattccagctcaccgaagcttgcccttacctgggtacgcattctgaggaatccaggtttggcatcctccacttacatctgcagcctttggaaatgaaaagggttggcgtagttttcacacctgctgactatggaaaagttacctcactcatactaatccggaataacttgactgttattgacatgattggcgtggaaggatttggagcaagagagttattaaaagtgggtggaagacttcctggtgcaggaggctcactccgatttaaggtgcccgagtccacgctgatggactgccgtagacaactgaaagacagtaagcaaattttatctattacaaagaactttaaagttgagaatattggacctcttcctataactgtttcgtctctgaaaattaatgggtataactgccaaggttatggattcgaggtgctggattgtcatcagttttccctggacccaaacacatcccgcgatatcagcattgtgttcactccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatgggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaa

SEQ ID NO: 2958 - DNA, 5156 bp, Homo sapiens
gacaactggtggacccgcacagaccttccgggaaagcgcggaattcagaggcagagtgtttccaatgtttgaggtactttagaatgtttactttgggaggtcaaaattgttgactatggctaactgttcccaagaagagctagatgaagagtttgaacagtttatgaaagagctttcagatgattcttttgaaaattcagacaaaacagctagacaatctaaaaaagagatgaagaagaaagatacagtgccttggtggataactgaagatgattttaaagatgatggacttcttggaacaaatgtgagctatttgaaaacaaagaagacttctcagcctgttatggaaatagaagaggagtctgctgaaaagattcaatttcttaagagcagtggaacctctctcttaagtactgatagcttagaaacaaatgaactagtagtttctgagctcaaccatagtagtctcggagtgggattggacacattagaagaacaagaggagaaagaacaattttttgccaggcttgagaaaggcttgacatcttccattgattattcgagattaaataaggaattggattctaatgactctacacattttaaagctttacatagtaatcaagccaacgcagaactaactgatgacgaacatgagaatgaatcgaaacatgaagaactggcagaaaattacagtgatgattttgaagatgagtatgttggtgcaccgttgactactaaagatgaagagatgccttccaaagagaattccaaatcagaaaaaataagtgtgcccaaacaggaagaagaaaaaactggcatgcttgctaatgttgtgctgcttgattcattagactctgttgcagaggtcaatcttgatgaacaagataaaataacacctaagccaaggtgcctaccagaaatgactgagaatgaaatgacaggaacaggtgtttcttatggacaaagcagtagtgacgttgaagccctacatcaagcttattgtcatatagcccattcattgggagatgaagacaaacaaaaaattgagagtaacacagtggaagatatcaagagctcagtgaaaggtcatcctcaagaaaatgaagagaattcaaaaaacatctctactatggaatctgatctgcccacagtagaggagctgatgaaacctatcagaatagattcctttgggatcagtggttttgatttacaacctgtcagctctgagaaagtggccgaaagaaaagaaactgaattttttagctctttacccctgaagatgaacccaaatattttgtctcaagactcacaacatgtgaaccttttttttgacaaaaatgatgagaatgtgattttacaaaagaccacaaatgagagtatggaaaacagctgtccacaagtaactgaagtaactgccacagaagaacatgttgataaaatgtaccttaatattttgaggaaaaaaataactgttaattcttcatcattatctcaggatgacaaaattaataaaacttacagatctcaacttagttctgaagaagaaggggctgtaatgggtaaacaggtaccatacaagaaggccagaagtgcacctcctttacttaaaaggaaaccccagagtggattatatgcgtcagttaggagctcaggctatggcaaacccagttcaccactcaagatgttttctactcttgaaaagaaaacttcagaggacattataaaaagcaaaaacttgagatcgatttctacctccaatcaacctaggaaaaaagaaatcttatctggaacaaaactcatcaagcctgcagctttggataaaccagctcacaaaactgaaagttgcctgtctactcgtaagaagtctgaaaatcccacagaaactgattcctgtattcagtttcagactgattccttaggatactgtggtgagaacaaggagaagaaattacttatgtttaaaagagttcaggaagcagaggataaatggaggggtgcgcaagccctaattgagcaaattaaagccacattctcagaaaaggagaaagaactagaaaataagttggaagaactaaagaaacaacaggaaaaagaactcttcaaattgaatcaagataattatattcttcaagccaagttaagcagctttgaagaaacaaacaaaaaacaaaggtggttacattttggagaagcagctgatcctgtcactggagaaaagttgaagcaaatccaaaaagaaatacaagaacaagagacacttcttcaaggatatcaacaggaaaatgaacgattatataatcaagtaaaagatctccaagaacaaaacaagaaaaatgaggagcgaatgtttaaggaaaaccaaagtttattcagtgaggtagcttccttaaaagaacagatgcacaaaagtcgttttctgtctcaagtagttgaagattcagagcccacaagaaatcagaattttacagatctgttagcagaactacggatggcacagaaagaaaaagacagtttattggaagacatcaaaagactgaaacaagacaaacaagctcttgaagtagacttcgaaaaaatgaagaaagagagggaccaagccaaagatcagattgcttatgtcacaggtgagaaattatatgaaataaaaattttagaagaaacacataaacaagaaatcagtcgtctgcaaaaaagattacagtggtatgctgaaaatcaggaacttctggataaagatgcacttcggcttagagaagcaaatgaggaaattgagaagctcaaacttgagattgagaaactgaaagctgaatctgggaatccatctattcggcagaagatacgcttaaaagataaagcagcagatgccaaaaaaattcaggatctggagcgacaagttaaggaaatggaagggattctgaagagaagatatcccaattctttacctgctttaatattggctgcatcagcagctggtgatacagtggataaaaatacagtggaatttatggagaaaaggataaaaaagctagaagctgatctggagggcaaagatgaagatgcaaagaaaagccttcgtaccatggaacaacagtttcagaaaatgaagattcagtatgaacaaagactagagcagcaggagcagctacttgcctgcaaattgaatcaacatgactctcccagaattaaagccctagagaaggaacttgatgacatcaaggaagcccatcagatcactgtaagaaaccttgaagccgaaatagacgttcttaaacatcagaatgctgaattagacgtcaagaaaaatgataaagatgatgaagattttcagtctatagaattccaggtggaacaggctcatgctaaagctaaattagtaagactcaatgaagaactggctgcaaaaaagagagaaatacaagacctctcaaaaactgtggagaggcttcagaaagacagaagaatgatgctatcaaatcagaactcaaagggcagagaggaaatgtctgccaaaagggcaaagaaagatgttttgcactcaagtaaaggaaatgctaactccttccctggaaccctggacagcaagctgtaccaaccacatactttcactgattcccatgtttcagaagttttacaagaaaactacagattaaaaaatgagctagaaggattaatttcagagaagaatgaactgaagatgaaatctgaagcagtgatgaatcaatttgaaaactccatgagaagggtcaaggaagatactgcagcacacattgcatccctcaaagcatctcatcagagagaaatagagaaactcctttgccaaaatgcagtagaaaattcttcttccaaagtagctgaactaaatcgtaaaatagcaactcaagaggtacttataagacatttccaaagtcaagttaatgagctgcagagtaaacaagagtctctcgtagtttctgaagttcgagaagaaattctacagaaagagattacaaaactcttagaagaattgagagaagccaaagaaaaccatacaccagagatgaaacatttcgtgggcttagaaaagaaaattaagcagatggaaatgagacatgcacaaagagaacaggaacttcaacagataatacagcaaacacaccaagtagtagaaactgagcaaaacaaagaagttgaaaaatggaaaagactggcacagttaaagaatcgtgagctggagaagttccgcacagaactagactcaatattagatgttctccgagagctgcaccggcaaggagtggttgtgccagttgcttttgcagatgaaatgaatgcaccagagtattaatagaaattcagatttcataatgaccttattaaaaggcctgaagatggatgggattgtgccactgtcaggacagcttatgaaaaacaagtgttccaatatgtttccagaaagcaaacaaccaaagcaacatttcaaaataaattgcctttaaccaataagaaaaaaaacatataatggtgtattttactaaaaatcattaaccagtctcattttaagtgatttatggacagtttcctttatagcagagaagggctcacttgtatgctagaaatagaaagaaaagaaaattgaacatactccgccacatttttattgataatgtgaggtttttaaaatttttattttagatccagggggtacatgtgcttgttgtaacatgggtgtattgaataatggtgggaattgggcttctagtgtacccatcatccaaatattaaacactgtacccaacaggtaatttttcaacgcttactgccgctcacactctttcccctattggagtccccagtgtctgttatctccatctttatgtctctgtgtacccattgtttagctcctacttttaagtgagaatatatgcaatattttattttttatgtctgatttagttcacataggataatggcctccagctctatccatgttgctgcaaatgacatgatttcattcttttttatagttgcataatactccatttatatatctctctctatatatatctcacgttttctttatccagtcaattgttggtagatacttaggttggttccatgaatttgctattgtaaatattgctgcaataaacatacatgtacagatatctttttta

SEQ ID NO: 2959 - DNA, 6732 bp, Homo sapiens
gccctgcgcccggggcgcctcggagaactgacctgaagtttcagtgtagtcagagagctcttcaagtaataaatcatggagaccagtcaggaaacttccctcttcttggtgaagatcttggaggaactggacagcaagcaaaataccgtttcttatcaggacctgtgcaaatctctctgtgcccggttcgacctgtcgcagcttgccaaactgagaagtgtgctcttctacacagcttgtctcgatcccaattttccagccacgctattcaaagacaagatgaaatgcactgtgaataaccagcaatcaaagaaaatcatggtggcagcagatattgtgacgatattcaacctgatccaaatgaatggcggggctgccaaggagaagctgcccacgggccgccagaaggtacgcaagaaggaggcatcctttgaatcatgtaggtcggacacagagatctgcaatgcagctgagtgtgagcccctgaactgtgagctgagtgagaggtctttcagccggggctaccccatcaggcagtcgtccaagtgccggaagatggactgcaaggactgcccacagtttgtccctgcctctgagcctaacttcctgttgggagttagcaaagaggtgaaaaaccgcgccgcttccctggacaggttgcaggccctggctccgtactctgtgaccagccctcagccctgtgagatgcagaggacctacttccccatgaacatcgaaaacgagtccatttcagaccaggactccctgcccatcaatcagagcatcaaggagaccttcatttccaatgaggagccatttgtggtccagtcctgtgtccagaaaaggaatatcttcaaagaggattttcacaatttgatggcagtgtcccccagtttggttggccccatcagcaaagcagagaatgagcacagggaaccccagagtcgaaaggaaccccacaagccacccttcttcaaccacagctttgaaatgccctataacagccagtacctgaatccagtgtattccccggttcctgacaaaaggcgagcaaagcacgaaagcttagatgaccttcaagcctctacatattttgggcccactcccgtgatgggaacccaagaagccaggcgctgtctagggaagcccaacaagcagactccctggccagccaaaagctggagcctaaacacagaggaagttcctgactttgaacggtcctttttcaatagaaatccctccgaggagaagctacactatccaaatgccagtagccagacccccaatttcccagccccagaaaggcgcccaacttaccttgtgccaaaggatcaacagccaattctccccattgcttatgcggcaaaacaaaatgggctcaaatctaaagagatctcatcccctgttgacctggagaagcatgaaccagtcaaaaagtttaaagacaagagcattaactgcaccagtgggcagctcagctcagacaccagtagcgtgggcacccagactgagcacgtgctggagcccaagaaatgcagagacctgtgcacctctggtcagggcaagtacagtgacaggcacaccatgaagcactcagacgatgactcagaaattgtcagcgacgacatcagtgacattttccgatttcttgatgacatgagcatcagtggctccacgggagtgatacagtcgtcctgctacaacagcacaggatccttgtctcagctccataagtcagactgcgacagttcccctgagcacaacttaaccaaaattgccaatggggtccccaacagcaagggagacaagggcaaccggcctgaaaacacccaccactcggaagaagagctgaagaccagtgtgtgcaaactggtgctcaggattggcgaaattgaacggaagctggaatccctgtcgggtgtccgtgatgaaatctcccaggtcttgggcaaactaaataaattggaccagaaaatgcaacagcctgagaaggtgagtgtgcagatagatctgaactccttgacaagcgagggtccgtctgatgacagtgcctctccccggatgttccacgcacacagtggctcccacggacccaaactagagaacaaccctgactggtgctgctctgatgctagcgggagcaacagtgaaagcctgcgggtcaaggccttaaaaaaaagcctcttcaccaggccatcctctaggtccctaacagaggagaacagtgccacagagtccaaaattgccagcatctccaactcgcccagagactggcgcaccatcacttataccaaccgtgtgggcctcaatgaggaggagataaaagacacaggcccaggagataataaagactggcatcggaaatctaaagaggcagacaggcagtacgacattcccccacagcaccgactgcccaagcagcccaaagatggcttcctggtggagcaggtgttcagccctcacccctaccctgcctccctcaaggcccacatgaagagcaaccccctgtacacagacatgcggctgaccgagttggccgaggtgaagcggggccaaccttcttggaccattgaggagtatgcacggaatgcgggcgacaagggcaagctgacagccctggacctgcagacgcaagaatctttaaacccaaataatttagagtactggatggaagacatttatactccaggatacgattcattactaaaacgtaaagaagccgaattcagacgagccaaggtctgcaagatagctgctctgatcgctgctgcggcatgcaccgtcatcctcgttattgtcgtgcccatctgcacaatgaaatcatgagctaagaatgcaaccttacgtacagcttatgactaccaatgtcgtcgtctgtatcttagaatcttgcagcagtgaggcaacaatttgttgaaatggagatgaaatcatggaggcatttctacaaatgttgaatgaaggtggttttcagaaagtatacattctagtgagaaatctacctacctattagctttgactcaattacactctgacgcatttttagaagtgcaatatcttttcctaccaaaagaacatcatggactatcaataaatacaaattgaatattccaagccaaaaaaggaagattaattgggttctttccattttgatgatgtttcatggtggggaataagttatacagaagatatttaatacacgcctctttagaagaaactaagggaaatagcaacataagaagaaaagaggtggcttctcttttccataatgttcttagaccattgctggtgaagtaacagggtgtgtgtccctaaagggtattacttctctgtcgacttttatcaagggctactgacgtttcattcttgcccttttgtcatcaacacgacagagtgtctgcatcactgcagatcttcatggaaacattctggaccttcttccttgcacttggagtgagaaggagctggactaccaagtcaggcgtggaatgaagtatgctcagactgcatgatgggccaaggtattcaggccaggagacctcgtcctcaatccaaagtgtaggggagctgcctgctaacgatgtaaggtcagtatttgaaaatcatggccactccaaaggatctcctgttcttgctttggtgtgtggctccattccttgattttctatctcctggtggtaccagatgctctgcctctcatacatgagttgaagagtttggaacttgtccttgtgccttgaagagtagagacaatggctaaacgttgacattctatctgtaaaccatggttttcacgcaccactaatatctgccattttcaatggctttaaaaagattttgaaagcttgctcaataatgttcaataatataataataataaaggcactgaggtcttctcagttaccccaacacctactccagagttttgaatacttgtcagcagtgcaaaaaatattatctgtttaaccacttatctatatgtctatctatctatctatatgtctatctatctatctaaatacttgatttttatttattgtcttctctgttaaataacttgagagcaaggtttctttcgtgtaaaagaagctgttgtaatttcatccaaatttgatctgtttccacctgctgaatggtgctctgacaataatggaacagaaagaatccttatcagcatctgattccaatgtcttgttacaggtcaaagaaaaaaggattgacagaaactagctaccttatatatattttttgataataaggtgggatataaatagattttggtagcaagtgtaatcactccgtatgatataataaatttctaaaagatttgagagcatctcaatttttaaagcaataggagtctagcatccattctgaaaaatcgcaaataatgcttagcttgctgtgtctgattctgttgttcaccattaaggggtagacagttaattttattatgttaacaagtgagggatgaatgttttcatctgtggtgaacctttatttttagaagtcttcatgttatctatttgtattatcatgtttatgtatggattttcaatttcagtaaccgaaaacttaagccttagtatgaaaaactgaggatttataattgaaaatgaaaaaaatatgttactctctatcatcagaattatagtctttggtgctctgttttcaatggggcatattacataaggttgtttctttcaccccaaagagactactaggttaccactctgggcattgcctttccacctaacccctcaaccagtaagactctacaccatattgtagccccactattctcctctttatcacagatgaagtgccagagcatcagagataggtagctcccaacctcttgctctggatttgcagaagagggggagatgtacttacccaggataagaaaaatctagtcaaatccaccccaaatcttccatttaacaggtaggaccatcgaggctggaccaaaccactttttccactgcccttggtgaatctattcctagtggaccccatttgggcatgtgcctagctaccttgggaaggcatgactataagtcacacctcaggcttggaaatgaaaggattctatagaatattctatactttccatagctggagaggtagtcagaaattcagtcttgctctgagtccacagtagctttaaaattcaactcaacattgttgtcacgtaacggaaacatctagacctggtaataatccaggaaattgcaaaatggaggccaaaagtaaggtgggtttctctggaaaggggtcatcctcagtctgataataccaagtctgacgctgaggttatgaatcattaccatggcttggagctattggatgcttggggtcttgggatagatagaaggtgaggttcacagttggagcttttcttgccattgaccccaagctcaccccagccttccttccctgaccctgagactcaccctatctatctcccctattccctcagtttgcagaatgagcaagatagagtctggctaggagggaaacatctatccatctctctaatctttgcccatcacctcctgttgcaatgagttcccgcaggtgacatacggactggcctctctactgtactgggtgccatctcccaccatactctggcatttttatgtaaaggataatttcttgtacctgagtctaaaattacaacgttatcaaaattcacttcgtttttcctgcattttaaaagtaataaaatattatttgagattattttgaaattaaatatccttaaccaatgattaaattcataatcatttcatcttctttcataatcatttcatcttctaatctgaatttgttttgaacacagccttgcagaaaagcaaaaaatatttccccgctcaaattttgccgacattttataccagtatccccttcattacagtaaactaaatcataacttacatcatccattactagctgatcataaattgttagtattttaaggtatgcaactatgtgattgacatctgtaaggctagtttaatagacgtgctaaatatcactgttctgaatatctgtgccatagttctgatacccttattggaatcaaggcagtgctgtttctgtttacaagttatcaagataagagcagtggcatcacatttgttgttgttgtttttttttttgaaatagaaaaaaacagaagaagctctgccaacaataaaagattttgttaagtggtataaaaatttgtgaatgttgaaattcaacatgcttcatattataaccaacctgcaagaatattgtggtcaattgtgtgaataccaaatcagtatatactgtatactgtactatgaaaatttgtatttaaaggcaaagatacaagtaattgttggtataattggggaaaagggtattcaatatttattaagtaacaatgagaaatgcaacaaacttccttatttatgccttatgaataaaagagtgtggaatgtaaggtgaaattttatgtgcaagatcctgaaggaatgggtattcttgaaggcagggactgtcttttctatgtttgttctgtacagctctcagcacactcttggtgcttgataaatgttatgttatataataccaataactaagcacatttttagatcttttttcaaatggcttgtgtaaaatttggttaatgtacaatggttggtttgaagctatcatgtaaaattggcctctccaaatataatcagaaataaaccg

SEQ ID NO: 2960 - DNA, 14877 bp, Homo sapiens
ccgcggcatggagcgggcgtgattcatcagcatccgcgccggggcggcatgggggcgcgcgcggcggccgcctaggcgcccagggccaggcagcggcggcttccccggcccggctcgcccgcgcttctctccctgtgggcggcggcccggcgcctggaaggtcaagatggaagaaatcctgaggaagctgcagaaggaggcgtccgggagcaagtacaaagccatcaaggagagctgcacctgggccctggaaactctaggtggtctggataccattgtcaagatccctccacatgtactgagggagaaatgcctgctgcctctccagttggctttggaatccaagaatgtgaagctggcccaacatgctttggcagggatgcagaagcttctgtcggaagagaggtttgtatccatggaaacagattctgatgagaagcagctgctcaatcagatactgaatgccgtgaaagtgacgccttcgctcaacgaggacctgcaggtggaagtgatgaaggttttactatgcatcacctacacgccaacatttgatctgaatgggagtgccgtgctgaagatcgcggaggtgtgcattgagacgtacataagcagctgtcaccagcgtagcataaacactgctgtgcgggcaactctcagtcaaatgctgagtgacttgactttacagttacgacagaggcaggagaatacgataattgaaaacccagatgtcccacaggatttcgggaatcaagggtcaacagtagagtccctctgtgatgatgttgtctctgtactcaccgtcctgtgtgagaagctgcaagccgccataaatgacagccagcagctgcagcttctctacctggagtgcatcctgtctgtgctcagcagctcctcctcctccatgcacctgcacaggcgcttcacggacctgatctggaaaaacctctgccctgctctcatcgtgatcttggggaatccaattcatgacaaaaccatcacctctgctcacaccagcagcaccagtaccagcctggagtcggactctgcgtctccgggagtgtctgaccacggccgaggatcaggctgctcctgcactgcgccggccctgagcggacctgtggctcggactatctattacatcgcagccgagctggtccggctggtggggtctgtggactccatgaagcccgtgctccagtccctctaccaccgagtgctgctctaccccccaccccagcaccgggtggaagccatcaaaataatgaaagagatacttgggagcccacagcgtctctgtgacttggcaggacccagctccactgaatcagagtccagaaaaagatcaatttcaaaaagaaagtctcatctggatctcctcaaactcatcatggatggcatgaccgaagcatgcatcaagggtggcatcgaagcttgctatgcagccgtgtcctgtgtctgcaccttgctgggtgccctggatgagctcagccaggggaagggcttgagcgaaggtcaggtgcaactgctgcttctgcgccttgaggagctgaaggatggggctgagtggagccgagattccatggagatcaatgaggctgacttccgctggcagcggcgagtgctgtcctcagaacacacgccgtgggagtcagggaacgagaggagccttgacatcagcatcagtgtcaccacagacacaggccagaccactctcgagggagagttgggtcagactacacccgaggaccattcgggaaaccacaagaacagtctcaagtcgccagccatcccagagggtaaggagacgctgagcaaagtattggaaacagaggcggtagaccagccagatgtcgtgcagagaagccacacggtcccttaccctgacataactaacttcctgtcagtagactgcaggacaaggtcctatggatctaggtatagtgagagcaattttagcgttgatgaccaagacctttctaggacagagtttgattcctgtgatcagtactctatggcagcagaaaaggactcgggcaggtccgacgtgtcagacattgggtcggacaactgttcactagccgatgaagagcagacaccccgggactgcctaggccaccggtccctgcgaactgccgccctgtctctaaaactgctgaagaaccaggaggcggatcagcacagcgccaggctgttcatacagtccctggaaggcctcctccctcggctcctgtctctctccaatgtagaggaggtggacaccgctctgcagaactttgcctctactttctgctcaggcatgatgcactctcctggctttgacgggaatagcagcctcagcttccagatgctgatgaacgcagacagcctctacacagctgcacactgcgccctgctcctcaacctgaagctctcccacggtgactactacaggaagcggccgaccctggcgccaggcgtgatgaaggacttcatgaagcaggtgcagaccagcggcgtgctgatggtcttctctcaggcctggattgaggagctctaccatcaggtgctcgacaggaacatgcttggagaggctggctattggggcagcccagaagataacagccttcccctcatcacaatgctgaccgatattgacggcttagagagcagtgccattggtggccagctgatggcctcggctgctacagagtctcctttcgcccagagcaggagaattgatgactccacagtggcaggcgtggcatttgctcgctatattctggtgggctgctggaagaacttgatcgatactttatcaaccccactgactggtcgaatggcggggagctccaaagggctggccttcattctgggagctgaaggcatcaaagagcagaaccagaaggagcgggacgccatctgcatgagcctcgacgggctgcggaaagccgcacggctgagctgcgctctaggcgttgctgctaactgcgcctcagcccttgcccagatggcagctgcctcctgtgtccaagaagaaaaagaagagagggaggcccaagaacccagtgatgccatcacacaagtgaaactaaaagtggagcagaaactggagcagattgggaaggtgcagggggtgtggctgcacactgcccacgtcttgtgcatggaggccatcctcagcgtaggcctggagatgggaagccacaacccggactgctggccacacgtgttcagggtgtgtgaatacgtgggcaccctggagcacaaccacttcagcgatggtgcctcgcagccccctctgaccatcagccagccccagaaggccactggaagcgctggcctccttggggaccccgagtgtgagggctcgccccccgagcacagcccggagcaggggcgctccctgagcacggcccctgtcgtccagcccctgtccatccaggacctcgtccgggaaggcagccggggtcgggcctccgacttccgcggcgggagcctcatgagcgggagcagcgcggccaaggtggtgctcaccctctccacgcaagccgacaggctctttgaagatgctacggataagttgaacctcatggccttgggaggttttctttaccagctgaagaaagcatcgcagtctcagcttttccattctgttacagatacagttgattactctctggcaatgccaggagaagttaaatccactcaagaccgaaaaagcgccctccacctgttccgcctggggaatgccatgctgaggattgtgcggagcaaagcacggcccctgctccacgtgatgcgctgctggagccttgtggccccacacctggtggaggctgcttgccataaggaaagacatgtgtctcagaaggctgtttccttcatccatgacatactgacagaagtcctcactgactggaatgagccacctcattttcacttcaatgaagcactcttccgacctttcgagcgcattatgcagctggaattgtgtgatgaggacgtccaagaccaggttgtcacatccattggtgagctggttgaagtgtgttccacgcagatccagtcgggatggagacccttgttcagtgccctggaaacagtgcatggcgggaacaagtcagagatgaaggagtacctggttggtgactactccatgggaaaaggccaagctccagtgtttgatgtatttgaagcttttctcaatactgacaacatccaggtctttgctaatgcagccactagctacatcatgtgccttatgaagtttgtcaaaggactgggggaggtggactgtaaagagattggagactgtgccccagcacccggagccccgtccacagacctgtgcctcccggccctggattacctcaggcgctgctctcagttattggccaaaatctacaaaatgcccttgaagccaatattccttagtgggagacttgccggcttgcctcgaagacttcaggaacagtcagccagcagtgaggatggaattgaatcagtcctgtctgattttgatgatgacaccggtctgatagaagtctggataatcctgctggagcagctgacagcggctgtgtccaattgtccacggcagcaccaaccaccaactctggatttactctttgagctgttgagagatgtgacgaaaacaccaggaccagggtttggtatctatgcagtggttcacctcctccttcctgtgatgtccgtttggctccgccggagccataaagaccattcctactgggatatggcctctgccaatttcaagcacgctattggtctgtcctgtgagctggtggtggagcacattcaaagctttctacattcagatatcaggtacgagagcatgatcaataccatgctgaaggacctctttgagttgctggtcgcctgtgtggccaagcccactgaaaccatctccagagtgggctgctcctgtattagatacgtccttgtgacagcgggccctgtgttcactgaggagatgtggaggcttgcctgctgtgccctgcaagatgcgttctctgccacactcaagccagtgaaggacctgctgggctgcttccacagcggcacggagagcttcagcggggaaggctgccaggtgcgagtggcggccccgtcctcctccccaagtgccgaggccgagtactggcgcatccgagccatggcccagcaggtgtttatgctggacacccagtgctcaccaaagacaccaaacaactttgaccacgctcagtcctgccagctcattattgagctgcctcctgatgaaaaaccaaatggacacaccaagaaaagcgtgtctttcagggaaattgtggtgagcctgctgtctcatcaggtgttactccagaacttatatgacatcttgttagaagagtttgtcaaaggcccctctcctggagaggaaaagacgatacaagtgccagaagccaagctggctggcttcctcagatacatctctatgcagaacttggcagtcatattcgacctgctgctggactcttataggactgccagggagtttgacaccagccccgggctgaagtgcctgctgaagaaagtgtctggcatcgggggcgccgccaacctctaccgccagtctgcgatgagctttaacatttatttccacgccctggtgtgtgctgttctcaccaatcaagaaaccatcacggccgagcaagtgaagaaggtcctttttgaggacgacgagagaagcacggattcttcccagcagtgttcatctgaggatgaagacatctttgaggaaaccgcccaggtcagccccccgagaggcaaggagaagagacagtggcgggcacggatgcccttgctcagcgtccagcctgtcagcaacgcagattgggtgtggctggtcaagaggctgcacaagctgtgcatggaactgtgcaacaactacatccagatgcacttggacctggagaactgtatggaggagcctcccatcttcaagggcgacccgttcttcatcctgccctccttccagtccgagtcatccaccccatccaccgggggcttctctgggaaagaaaccccttccgaggatgacagaagccagtcccgggagcacatgggcgagtccctgagcctgaaggccggtggtggggacctgctgctgccccccagccccaaagtggagaagaaggatcccagccggaagaaggagtggtgggagaatgcggggaacaaaatctacaccatggcagccgacaagaccatttcaaagttgatgaccgaatacaaaaagaggaaacagcagcacaacctgtccgcgttccccaaagaggtcaaagtggagaagaaaggagagccactgggtcccaggggccaggactccccgctgcttcagcgtccccagcacttgatggaccaagggcaaatgcggcattccttcagcgcaggccccgagctgctgcgacaggacaagaggccccgctcaggctccaccgggagctccctcagtgtctcggtgagagacgcagaagcacagatccaggcatggaccaacatggtgctaacagttctcaatcagattcagattctcccagaccagaccttcacggccctccagcccgcagtgttcccgtgcatcagtcagctgacctgtcacgtgaccgacatcagagttcgccaggctgtgagggagtggctgggcagggtgggccgtgtctatgacatcattgtgtagccgactcctgttctactctcccaccaaataacagtagtgagggttagagtcctgccaatacagctgttgcattttccccaccactagccccacttaaactactactactgtctcagagaacagtgtttcctaatgtaaaaagcctttccaaccactgatcagcattggggccatactaaggtttgtatctagatgacacaaacgatattctgattttgcacattattatagaagaatctataatccttgatatgtttctaactcttgaagtatatttcccagtgcttttgcttacagtgttgtccccaaatgggtcattttcaaggattactcatttgaaaacactatattgatccatttgatccatcatttaaaaaataaatacaattcctaaggcaatatctgctggtaagtcaagctgataaacactcagacatctagtaccagggattattaattggaggaagatttatggttatgggtctggctgggaagaagacaactataaatacatattcttgggtgtcataatcaagaaagaggtgacttctgttgtaaaataatccagaacacttcaaaattattcctaaatcattaagattttcaggtattcaccaatttccccatgtaaggtactgtgttgtacctttatttctgtatttctaaaagaagaaagttctttcctagcagggtttgaagtctgtggcttatcagcctgtgacacagagtacccagtgaaagtggctggtacgtagattgtcaagagacataagaccgaccagccaccctggctgttcttgtggtgtttgtttccatccccaaggcaaacaaggaaaggaaaggaaagaagaaaaggtgccttagtcctttgttgcacttccatttccatgccccacaattgtctgaacataaggtatagcatttggtttttaagaaaacaaaacattaagacgcaactcattttatatcaacacgcttggaggaaagggactcagggaagggagcagggagtgtggggtggggatggattatgatgaaatcattttcaatcttaaaatataatacaacaatcttgcaaaattatggtgtcagttacacaagctctagtctcaaaatgaaagtaatggagaaagacactgaaatttagaaaattttgtcgatttaaaatatttctcctatctaccaagtaaagttaccctatgtttgatgtctttgcattcagaccaatatttcaggtggatatttctaagtattactagaaaatacgtttgaaagctttatcttattatttacagtatttttatatttcttacattatcctaatgattgaaaactcctcaatcaagcttacttacacacattctacagagttatttaaggcatacattataatctcccagccccattcataatgaataagtcaccctttaaatataagacacaaattctacagtattgaaataaggatttaaaggggtatttgtaaactttgccctccttgagaaatatggaactaccttagaggttaagaggaaggcagtgttctgacttctttaggtgatctgaaaaaaacacccttatcatccagtgtaccatctagagatcaccacagaatccatttttttcccagttccacaaaacactctgtttgccttcagtttttactcactagacaataattcaagtttagaaacaggtaatcagctatttgatcttaaaaggcaatgaattgttgggatatcagtgaactatgttgtatacttttgaatttttacattttataaatggaattgaaagttggataactgctttttttaaattttccaacagaagtaacaccacagttgctttgtttctttttatagcttacctgaggttcagttcttctttgtgaacctgtgagtactccacagtttactgggggaaaaggcttcagtaaagcagaggctagaattacagtatttatacatagcaacttttcataaagtagaaaaattcaaaggaagctgtctcaatttgagaataccagctgggcacggtggctcacgcctgtaatcccagcacttactttgggaggccaaggtgggcagataacctgcggtcaggagtttgagaccaggctggacaacatggtgaaacctcgtctctactaaaaatacaaaaattagccaggtgtggtaggatgcacctgtaatcccagctacttaggaggccgagacaggagaatcgctcgaacccaggaggcggacgttgcagtgagccaagattgcaccattgcactccagactgggtgacaagagtgaaactccatctaaaaaaaaaaaaaaaaaaaagtgaatactgtatcccaaagtatgttagttgtttgtttggaaatcagcattctccccgatgctctattatgggatccaaaattcttgaacataagtttaccctgtactgtgtccaaacactgttctagttctagcctgattatgggtcccaagaataaaaggatgagtaggtgtacagagctcttgacctacaattttttaagagtgttttggtaccttcccattgtcttctctataactcagtcctaacatactctgcactcgagttaccagccatccacactgacatcagatttcaaccagaaccatcactgagtgacagcagtacttctcagaggtatttgcagcttgatgcaaagtagtctctaatgagtaggcattcaggtggttcttcccagcaggtggagaagaaagggaggagatgaagaacactgagaggggagtggcaccttcccaggctgcccagctcagtctcttgccctgttcctgtgactcagctgcccactcccccaactttgtttccctccctcccagtctctgaaagtgtcaggtgtttctctcctcacagtctcttttgcagcaacagtaagacaaaattcaaggcagccttttaaagttacgaacagttattagcatgtatttacagacctaagcagaatgagagtttatacattgtttttagttgcctgtatttatagccaaaagtatattaccttaaagttgagatctttctcttcttttcctaaattttggtaaagtgtgcttcatgaaacaaacatctggaaaactccaagtataagagaccctggactgatgatggcccagccaagtatatggagggacagagttctctctgtcattaatgaggacatcggttttcacaattgaacctcatgcactgtccacagcatctcacctagctcctgtatctcctgatctgcttttaaaaatagttagttaggctgcctttttacaccaccttctctctctccccttgtggtaattttccagccttccccatagatataaaactagaacacctttatgatttggggtctatgtaatgactgaccgataagaacccaggcagatgctaacatacttaacagctcgcattaaaatactttaaatcaggcgtgatggctcattcctgtaatctcaagcactttgggaggctaaggtgggtggatctcttgaggtcaggagttcgagaccaacctggccaacgtggtgaaaccccgtctctactaaaaatacaaaattagccgggcatggtggcagctgcctgtaatcccagctactcgggaagctgaggcaggagaattgcttgaacctgggaggtggggattgcagtcagccaagattgttctgcagcatgggtgacaaagtgagacttcgtctcaagtaaataaaactaaaatttttaaatcaaacatgacaaaaatgttaatataattcagaagtaccttgaaattgaaacatatttgtgcaatgatcattaggctttttgtccttgttgttttaaaatgaggcttatacagagtgagttgagagtcaagtagccttcgctgtgagacggtaatgcagttatataatagatacccttgactttgccagattcatcacaatactgcttatacaggaaagttttctcagaaaggaaaatccattagtatcagtcccatcaagccaaacagaatgaagacctttgatagtaatagcaagaggttacaaatagcagggaggaggcgagtagtgaatgtcactgtgattgcaaacccttacctgtattatcacacgtagtcctcacaacaaccttgtgagacaagtgttgtgttcctcattttttcagaggggaacacagacccagagaggttaagaaatttgcccaagataacaagtaaaaggcaaagttggttgcaaaagaggtgtttctgaattcaagggccatactctctctctgacaacatgctctaagtccatagagtaagcactctagtatgaaaaaaagtttcaaggaacgaggccatgaaaatgagactatttgacatctcagatctgtctgggatgttatggaggtttttaaaaataaagttgaaaaaagaaaatgaatcatgtttatacataaaaaaatcacatgtaacacatttcaagtgtttgaaaataaaaccaaaatctaaactttagtcttcaagcagacattcagtgttactttagaaaactcactgaattaggtggaaatgatggaataatactattcatggccagctattaacacagaagaacatggcagtgtgtgtctggaacggcatgcacaatttgtaaacctttttcaaatatcatttaatcaactcagaataaagtgccctgtagccaacagtgcctctttacttgcttctctgggaaatacatggtactaaattagtagcacaaagtttgggaatatgcaaaataatggataaccatttttcaaaatgtacattctctgaagaggaagcagctggttggacaggatttcttgaagagccaggtgctaagggcatcaggtcgacatccatagtaaccatgtgccataacatctacacatttccacttgttttacagacaaggtaacaggcagaaggaaaatccagagtcttgcagtaagcagatgacaaaacttcaatatgcttgggcaccacttaggtgaccccagggagatttagtgtggccttaggaaagcaaaagagcactttttattggaaatatgagcttgtcactgggaaagatttgtaaaattgatcaagaacttgatttataattatgcctcaaaaaaaaaagttctcatttagtagtggagcaatctagaaaacataccttttttgtttgtttggaagatcctctttccctggctgtattgtagtgtttgctatttgatgtggaaataactaataacttaagattttggaacagaacaccctttagatttccaaaacacaattcttatttcagggaagacagaccaaaaatatctcctgagatcattggtttctttataaattgtggtaccactccatcattgaagagaaaccactaccacaccactagcaccatacagaaccttttctctgtatctttgtacaatactacaaaggggtaccagggaggagagagtggctgaccactttagtgacaaaacagcactccactgctggtgaatcccatctaattatggtccttccacccttttcaaccaccaacaactgttcgtactgttaattcctatcctgaaggtttaaccagtggttgtctagtatcttctgtctttagaacagtggttctcaaactttagtacacatcagcatcacctggagggcctttttttaaaataagacacagattgctgggctcatggtcagagttcccagttaagtaaatcaggaaatttgtatttctaacaagtttataggtgaggccaatactgctgttttgggaactatgctttgagaaccactgccttgaaaaaatttccaacttctacctttaagatcagcctgacttatcaaacgctagagaaaaactgaatctacccttgggcagatgacttgggattggattctatacagcagtcttgctcaatcttcccagtttccagttttattataccaacaattggtttttacaagctagaagacaatgaatgtataagttctatggaacagtgagataaatctaagcttcttgtctttgtatttagaaacattgattctatggatgatcatttgtatcatgttgaccctttgacttgtactgaaggtgattttaaatttaagtatgtagtgtttgaatttcttccatccatgtcgttttaatgagatgtttccatgtcagctcctttacagccttggctcctggcttacagatttttgaatagttgtttgcttgccagttgttttacatctttcattggccaccaaaatattagccatttgagatgagatgagactacttgttgtaccttcatctttcatttaattttctggcgtaaattaacattttaatttcatatatatctgtaaagagtctacccaaaggcttcacggaaatttgcaaaatgaactaattcccttttaagcagcaggtgtgcctgtttttgacttttcagtaaatatgttgtttgtgcacatatctacatggtggagaccatattcattatttcatcttccaaataatgggaaaaatataaaagtgaatcagtgtgctttgggaattcagtgaaatcatgttaactcatatagagggggccttagtttatctcttctttactgaattaattagttttggaaattcttttaccattaaaaaaaattaaggaccatacagagaatgatttaagaaaaaacaagtcacttaaaaatcatcacctatttataaactgtattaattacacataatgcttattgattcaatgaggtttctctaaagacttctgcttaataaatatgctgacttcatttaaattagtttagactattgtaggaatggaaggaaatgattatatttactagaattagtgagatcagaaagcatatcagaatgttgatgatatcaaggagacaatctacagagtttttgcctctgtggatggaaataagggtgtttttttttggttttttttttactttagtttcccataatttttggaaattatgtgtgcatttagttcttttagtaacactgattttaaaattaaatttcaaaagtcaatctctaagagtaatttatttttgttttaccaaccagtgccaaaaaggagaggagggaatccaaaagccaatcttttgaaccaatgtgtaaaagattatgttttttcttaaagttagggaggctcgggccctgacactgccagccccagtgagcatccctggctacctcgggattatgtgcaagctgctttgtcctacatttctttcatctggttcttattgggagtgcttctctctaataaaaattgatttcccacaaaataggcaaagctgaacaaagatgaatgcttttgataagttgggtttcacttcagttgaaacaatgtgatagaatatccaggtgtggcatgatggggcaggaggaggtgcctagagggaaaagttatttttgtttcttagtgttgtgttgtggggatgggacagataagaataagatgtttattgccctaatcatgctaagagactattattcaatatgcttttcccgcttttctaagaggaataaacttagacaaattacattataaacagttcccctactactatctcccactctagataaagccagtgggtggtatgggtccttttattccttatagtattatgccaaagaatcaacttattttcattgaagattataaataaatgaagcttgttatagccataatgatttgagtcagtataccattttacctataaaatgcaaaattcatccttgcaaccccattcaccaggagccttgaagcattttgtttactccaaaggccttgtcaaggaagcataattttttgttttgccttcttatttagtcagtttggtcatatttacttaaaaaaacaaactgaaaatcacactcctttatatgttgatataactgattttatagaatctgtctgttctttgtttaacaggtctctgtaagcaagcttgcaagtgtattttgtgtacattttatctgaggtggaaatgaaaattctaaagagaaaatattttaaaagatattgtatttatgttgcttgtgttgtagaataaagattcaaatgcattaaaaatctggtacatgaaacaattgtgtttactgaataaatatatataaata

SEQ ID NO: 2961 - DNA, 3442 bp, Homo sapiens
agaggacagagggaggaggaaggatgggcggtgttggcgtagccgcagggaggtgactgaagcgagcctggcctcttgcatcctccgcctgtgtacctccctcccctttttttccgccttctgccagcagaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgttcagaatgaccagtgccagcccaatgcagatgactccaggtggatgaagaccacagagaaaggatgggaattccacagtgtggagctaaatcgaggcaataatgtcctctattggagaaccacagccttctcagtatggaccaaagtacccaagcctgtgctggtgagaaacattgccataacaggggtggcctacacttcagaatgcttcccctgcaaacctggcacgtatgcagacaagcagggctcctctttctgcaaactttgcccagccaactcttattcaaataaaggagaaacttcttgccaccagtgtgaccctgacaaatactcagagaaaggatcttcttcctgtaacgtgcgcccagcttgcacagacaaagattatttctacacacacacggcctgcgatgccaacggagagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagaggactcctgatggatttgactcagtgccgctgaagacatcctcaggaggcctagacatggacctgtgagaggcactgcctgcctcacctgcctcctcaccttgcatagcacctttgcaagcctgcggcgatttgggtgccagcatcctgcaacacccactgctggaaatctcttcattgtggccttatcagatgtttgaatttcagatctttttttatagagtacccaaaccctcctttctgcttgcctcaaacctgccaaatatacccacactttgtttgtaaa

SEQ ID NO: 2962 - DNA, 4808 bp, Homo sapiens
ctcagctctgtccccagcaagcgggtcccacctttcccggtcccagccccacgcaccgccgctcggaactacacttcccggcagaacgcgggcgcgcgcacgcgcaccggggcctcagccatggcgaccgtgctgtccagggcgctcaagctgccggggaagaagagcccagacctaggggagtatgatccacttacccaggctgacagtgatgagagcgaagacgatctggtgcttaacctgcagaagaatggaggggtcaaaaatgggaagagtcctttgggagaagcgccagaacccgactcagatgctgaggttgcagaggctgcaaagccacatctttcagaagtcaccacggagggctacccctcagaaccccttgggggcctggaacagaaggcggcctcctccctggtgtcatatgtgcgcacgtctgtcttcctgctgactttggggatctcgatgatcctggtgctcctgtgtgctttcctgatcccctgtcctcccagagatctgcacagcacctggagccgccacttgggctcccagggaggtggggacctgtctccattggaattggctgatgtgaatggagatggcctgcgtgatgtgcttctctcctttgtgatgtcaaggaacgggagtgcagtaggtgtctcaagaccagctgctaatcttgtatgcctttcggggatgaatggcagcacactgtggtctagtcttctccctgaggaggctcgagatatcacatgtttggagctgatgccaggaagcttggctgaaaccatctgccttgtgacagggacacacaagatgctcagcgcattcaatgcaacgtcagggaaagccatttggactttaaacccaaactacttgtccaacggtaccttggctgccccagttgtggtactgccagacttggatgaagacggtgttcgagaccttgtggttctggccattggggaattgcagccagatctgtgctttctgctggtgtctggccggaccggaaatccagtgggtcgacctgtgaagtacaacatcgttggagttgggaatctgattggtcctcaggtttacatcaccacaaatggggctgtctacatcctgtttggctttggaaatatacaagctgtcgcactgcgggacatttttgttcaggcccaaaatcgagacagctcaccaccttctctgcagatagaagagccagaatgggaaaagcgaagatccatcaacctgtctgagctcattgatgtttacagtgatggtgttgaactactccagatggtgaaggcaccagattccaactgcagcaaccttctgattacaaccagacaaagccttgtgctgcttcgggggcaaaatctgacaccttactgggcattgagacttcaaggcctgcgcagccagcctactcctggatatttcactgatgatcagacattagatttccttctgcagatacaggatggagttgggatgaaaaagatgatggttgtggatggtgactctggctccattgtttggagttaccgtgctccgtgtcacatgaaagaaacgccagccacctcagcagttacttcagaccagaagtctgtcttcctcttctgggccgaagggctgtcagctgcatctcccaattccgatatcatcctaggaactgagccgcccagccttcaccacctttacctcctgcatcctgcgttcccctccatccttctggatctggccaacaccaccggcacagtgacggcttcagaggttggaattaacgacctctggaaagatgccttttatgttaccaggacaacagggccaagctccgaaggccatccagcagccctggtggtcagcaagcttagtctacggtgggcactaatggagggccagatggctcagctacaggagtccacccccaaaattggccgtggggagctgcgaagatttctctctaggataaagtttgttgaagctccctacgagatctaatctgatggaatcttcagttgcagaagaagtgaacagagtggataccctctctactctcctgtcactgtaaaatcagttctatggagagaagacttcttcgtcctcatttaccacctccctgatggttgcaaaggcttgggaaggcatgttggagtctttgacggcagcatgatctatttggctggggcatcttacctaccttttcagtccctgcattaatcccctctaggaactctgcgtggatcgtttggaaatgtgaatctcttaagtatttaatttttttggtatgtctaatttatgaagtcttgctgggaaagccagtgaagtctatgactaggaaacattttgttgtacattgtgctgtgtgtgtgtatattttagtgttgtggtgaagttattttccaggtatgtcctaagcttcagggatccagtttcttgtccttctgaaatatatctggtttgtttggtcattttgagacttccagatgccctacctctgatgttgagggccacttatttctctccttattctttcccacctgtaccttggctacttccaaattgtagacagaatgagaaagatttatagtggaagactgagttagccatccaagcattttcatctctcttgttttatatcctatttccttagattttccatccatgtctattaagtgaccacaagaataactatattcctatcacaaggggagcaagaggatgtagtctcagtgacccatctctgaccaagtccacatgttgtgttatatgtggctctgatggttctgccagtcatgatcttttttctgtggcgacatcagaagtgtatgtttgcatgctgtcttcaacttagaggagaactggaagtcaggagcctttgatgtccttatcctgctgtatgtcttctctgcatctttttctatagggcaccctccttagctcccctcactctgttttctcttctattcagggatatgtttctggactttttcttctgctacttgagtccaggatgcaaccattttgtcctgcatctcttctttcctgtagagcctttgaagcattgtattttgggaaaattcttctgtaaatactataacttttataaatggttaagttatttagaattatctccagtgcttacttctcccttcttctgtataaatctgctacttcaattaagttctcctctaaacttttaggtcattgtttatatagcagaaaattcaatgttagcggatggaaaactgcttcttgaataaccttgataggtcatccctgagtgcacctcaggttctctctttacctgggcttgtatcttttttttttttttttttttttttttgagacagagttttgctcttgtcgcccaggctggagtgcagtggcacaatctcggctcactgcaaccttcgcctcctgggttcaagcgattctccagccttagcctcccaagtagctgggactacaggtgcccgctaccatgcctggctaatttttttttttgtatttttagtagagacggggtttcaccatgttggccaggctggtcacgaactcctgacctcagataatccacctgcttctgcctcccaaagtgctgggattacaggcgtgagccaccatgcccggctgggcttgtatcttttagcttgtgttagtaaaaggattctagaaaattatgaagtccagattcaaagggatctctgttaattacccactgacaggcattatgacctaacaggaggttggtagcagtagatccaagcatgcatgttgcctggcctgtagattggccttatcaggtttctgggtgcctctgccttaagatcctgaaggcaaattttgtttcaacagtttggaagtcatctgtgggtccagcttgactttggaggaataagaagatacttctagagtatgggaatgattccagataatttctgggatttgaatctacttgagtttaagggcctgggacctaatttggtttagtatagaatttgaagaattaatttataggcagctgaatacccaaaacttgggtggtggtcctgtggtttggctgagctgtccgggcataacctggttctctgttatgttaaggctttctgggaagccagccactctgcgcaggagtgaaacatgaagttgttttctgaggacctgttttggtgggattgtttgggcagaggactgtgtttatgcagggcaaatcccagaaagataagaggaagctagagaaacttaatgtacctgaattcttcatggtgtatttgcaaactaacttaacatagattcttttgactatggtaagtttgaatctctccttgccaaacaacattataagtttagttttcttcttcctcttgcagccggtacagaaaggtgtaagtggtggctgaaaattgaggaagcttcatctgaccaatgtgggtgctggtttcttgtgaaatgtgtccctaagcctccttctccttgcaggcagccacccacccaggtgtctaagataggacatgctcctttctttctctaatcccatcctgaggttgccggcaaagccaatatgaccactactgagaaatagtaatgacttctacaaatgcaagggtcttaccctcctctttcccttaaacaccctcccttttccttagaccccgtttttgccatcccccaaatgtgtggtatggtgaaactaatcccctgaatgtgaattgctatccttattgccctattaaagaagagccagctggtatattgtcaggaagcactatttaaaatgtgaactgttatagagtaaataaataaatactctacaggaa

SEQ ID NO: 2963 - DNA, 2623 bp, Homo sapiens
gcacgcgcaccggggcctcagccatggcgaccgtgctgtccagggcgctcaagctgccggggaagaagagcccagacctaggggagtatgatccacttacccaggctgacagtgatgagagcgaagacgatctggtgcttaacctgcagaagaatggaggggtcaaaaatgggaagagtcctttgggagaagcgccagaacccgactcagatgctgaggttgcagaggctgcaaagccacatctttcagaagtcaccacggagggctacccctcagaaccccttgggggcctggaacagaaggcggcctcctccctggtgtcatatgtgcgcacgtctgtcttcctgctgactttggggatctcgatgatcctggtgctcctgtgtgctttcctgatcccctgtcctcccagagatctgcacagcacctggagccgccacttgggctcccagggaggtggggacctgtctccattggaattggctgatgtgaatggagatggcctgcgtgatgtgcttctctcctttgtgatgtcaaggaacgggagtgcagtaggtgtctcaagaccagctgctaatcttgtatgcctttcggggatgaatggcagcacactgtggtctagtcttctccctgaggaggctcgagatatcacatgtttggagctgatgccaggaagcttggctgaaaccatctgccttgtgacagggacacacaagatgctcagcgcattcaatgcaacgtcagggaaagccatttggactttaaacccaaactacttgtccaacggtaccttggctgccccagttgtggtactgccagacttggatgaagacggtgttcgagaccttgtggttctggccattggggaattgcagccagatctgtgctttctgctggtgtctggccggaccggaaatccagtgggtcgacctgtgaagtacaacatcgttggagttgggaatctgattggtcctcaggtttacatcaccacaaatggggctgtctacatcctgtttggctttggaaatatacaagctgtcgcactgcgggacatttttgttcaggcccaaaatcgagacagctcaccaccttctctgcagatagaagagccagaatgggaaaagcgaagatccatcaacctgtctgagctcattgatgtttacagtgatggtgttgaactactccagatggtgaaggcaccagattccaactgcagcaaccttctgattacaaccagacaaagccttgtgctgcttcgggggcaaaatctgacaccttactgggcattgagacttcaaggcctgcgcagccagcctactcctggatatttcactgatgatcagacattagatttccttctgcagatacaggatggagttgggatgaaaaagatgatggttgtggatggtgactctggctccattgtttggagttaccgtgctccgtgtcacatgaaagaaacgccagccacctcagcagttacttcagaccagaagtctgtcttcctcttctgggccgaagggctgtcagctgcatctcccaattccgatatcatcctaggaactgagccgcccagccttcaccacctttacctcctgcatcctgcgttcccctccatccttctggatctggccaacaccaccggcacagtgacggcttcagaggttggaattaacgacctctggaaagatgccttttatgttaccaggacaacagggccaagctccgaaggccatccagcagccctggtggtcagcaagcttagtctacggtgggcactaatggagggccagatggctcagctacaggagtccacccccaaaattggccgtggggagctgcgaagatttctctctaggataaagtttgttgaagctccctacgagatctaatctgatggaatcttcagttgcagaagaagtgaacagagtggataccctctctactctcctgtcactgtaaaatcagttctatggagagaagacttcttcgtcctcatttaccacctccctgatggttgcaaaggcttgggaaggcatgttggagtctttgacggcagcatgatctatttggctggggcatcttacctaccttttcagtccctgcattaatcccctctaggaactctgcgtggatcgtttggaaatgtgaatctcttaagtatttaatttttttgccggtacagaaaggtgtaagtggtggctgaaaattgaggaagcttcatctgaccaatgtgggtgctggtttcttgtgaaatgtgtccctaagcctccttctccttgcaggcagccacccacccaggtgtctaagataggacatgctcctttctttctctaatcccatcctgaggttgccggcaaagccaatatgaccactactgagaaatagtaatgacttctacaaatgcaagggtcttaccctcctctttcccttaaacaccctcccttttccttagaccccgtttttgccatcccccaaatgtgtggtatggtgaaactaatcccctgaatgtgaattgctatccttattgccctattaaagaagagccagctggtatattgtcaggaagcactatttaaaatgtgaactgttatagagtaaataaataaatactctacaggaa

SEQ ID NO: 2964 - DNA, 6751 bp, Homo sapiens
aaggttggtggcaaccaggagccggggaagaggccagcagctgcagggagaccgcagccagcggagggggcttctgatccctcagtcacagggctcggcaggcagctctggacggatcaatgcaagccagacgatgaccagttgtggccagcagtccttgaacgtgctcgccgtcctcttctcattgctgttttctgcagtcttgtctgcacatttccgggtctgtgaaccatacacagaccacaaaggccgctaccactttggcttccactgcccccggctctcggacaacaagaccttcatcctctgttgtcaccataacaacacggtcttcaaatactgctgcaacgagacggagttccaggcggtgatgcaggcgaacctcacggccagctccgagggttacatgcacaacaattacaccgccttgttgggagtgtggatctatggatttttcgtgttgatgctgctggttctggaccttttgtattactcggcaatgaactacgacatctgcaaggtctacctggcacggtggggcatccaaggacgatggatgaaacaggacccccggcggtgggggaaccccgctcgggcccctcggccgggtcagcgggccccacagccgcagcctcccccaggcccgctgccacaagccccacaggccgtgcacacattgcggggagatgctcacagcccaccgctgatgaccttccagagttcgtctgcctgaaaacgcttttgctgtgcctcaggatgggggagatgagatctgaagcacccggtgcagcctccgagaagaacaacttctacagagatgccagggacagccgaggtagcggcggtggcacaggaggaaatgctgcctgtgcccaaagcccccttccgcggacttctaagattaggagcaaactcaggggtaggggctgggggtgcaggggaggggattctgagccacctgtccgcaagcaatagtcctattttgggctggtggcttctgagaggtgactcattgtggactcaggatgaccaagacaaagcaactctggctgattccagccaggaggattgaggcctgtgagttatacctgtggttgaaaaccgaagcttcccttgcccctgctccctccagtagtggccccttggggctatttgtgtcagaatattgaatgtgcgtgtgtgtgtgcgtgtgtgtgatttggggtgttctttttgtttgcttggttggttggtttttattggggcttcccccctcaagttctctgatgggcatgagtcaccctccggctgggggttctcatccgtgtcaatgtccgagccgcaagcttattgctaagcacagggtacggcccctctgtgtctcggggagcactggggatttgaaaatgccagtcagggttgtttcttacagaattcgttcctgtaacaatagtaatactaagggctgcatctcaggctgaccacagggcaggtgccaagttaagtgttttcatgcactccctctctcaccacctgggaggcaggtatgattaaccccctgcagaaaaactcacagtggggaagcggtgccggaacccaaagtccaggctccaactccctggacgtgacatgctcgccagccggggtacaccctgcacaatgctgggagcatctccttgatgcctccaccatcaccgcctggagcgctgatccactcagcacattctggctaagcatctgctgtgtgccaggccccgtgctgggcagtgatgggaatgaaagatgagttagatctcatctctgcccccggggagcctcccatctggtgggagacacagacacgtggatctttgctggaaagggtaacaaggccatggaaacccaggcaggagcgttctagaaatccatccactttcaagtaggacttccatgcccgtaacatccacccaccgagctaatcacccccactcctgccccgctgccctgggacacctatgagatggcatcacctaaatcatcacaaacatctccaaaggccatgctgccagtgtagacacactcattccatgggtgttagtgataccaaatctcccccagctcttagctcgggaggccctgcttgatcaatgtgtgtgtcctctgacgcagtttcctcatttcatcagacctagtgttctcacactgaccacccatccattcaccagacacgacagtgagcaaggcaggtccctgctcactgtgctagctttctagctggggcaggaagacagtgaagaaggaaggtggcgaaggcagtgagtgctctgccgggaactcagtgccaggaactcagttcgagggacacgtgagtgagacccttgtggacctggggtggtctgggaaggccgccttgagcagatgattgaagcccagatttgaatgacacacaggagccagtaatgggcgttaaagataggaaaagagcattccaggcagaaggaacggctagtgcaaagatcctgcggcagccacaggcttggtggtttcaaggaagcacaagaaagccaggtggcacaagaaagccaggtggctggggacccagagggaaggcagaaggagatgagggtgatagtgcccagctctgggctctgctgtgagtcaagctgtgcaaacacaatgtcctgcctttggaaaagcagaacaaacttgctagggtataaagcatcctccattctgcctggctgtccatcctctcaacagccccatgaagaaggggctctccccattttatggacaagaagacagactcagctgggtcaagtggcttgcccaggatcacacaggtcagctgtggaagacccaggcccctggcttcagtctttgggtccagctgtctcctccaggcagtgctgccagtgtccaggcatatggcttggcaaagtgggagaacctctgcttggggtctcgattggagaaaggaatggcttcctctcccctgatgtgagccgtcccagggccatgttgccgtaagggggtgcacagcctgtccactagcccagctgcggaagccacagctgtgtcccacgtgcagtgcctcagaaggcagaggaagccttgaggtgggggcccaagacccagattctgacatcagctctgccactgagaacagcgtgacctcaggcaaggtctgttacctcagtttccccatcggtaagaggaaggagtcagatgggtatttaaggagtttgcaaccctcgtgtcctgctgtcctggacaatgctctgtaggtgcttcctctgccaaaaaggaactggtggccttgcctccctctcctggacacctggggtcaaaggtcactgccaaatagacagctagaactggggttcacctaagcatcccttgagatgtacaaccttctaggaggacattcctcctgcctgcccccctccccgcaagaggtcttttcaggaataactgaaaaacccatggggtttgtggtcctgctgctctgccaagtccctcttgggcagctgggctgaggactggaacattctgtggcaagcaggaggcctcagcagagatcaccaagacccagcacacctggtgcagacagccacggcatcctccttcctgcaggtcacccccacgagccacttaacctctcagagcctctgcttctcacctgtcaagtgtgtgaggtagggtaccagttagtcacggtacttgctgtctcacagaggagccgacaggtgagaacagtgtgcatgtgggtgtgaacactcagtgtggaaagcaggtgtgtgtgtattcaatcccccaatggtgtcaagggctcctcaaaatgccatgggtccccaggtcattgtgataaacactgtccccatcctgctgtggttgtggctggaaggtccctcaaggagtagactgtccctgagaacaagatggatgcagggtagtgacgagttcaagcatagctagagttactgttttttagcaactcaacctgattttttaagctgcctacttttactttttactgtgagcttctgtccatcaccatgtaatttgtaataataataatacaaaaagaaaaacgagagagagaagaggacaagatgtccacagaggaatctgcattcgaggctgtttgcagaactaccgcgtttgtaaggactgtttcccactgggaactgtgtgtaattaatgagcagttttatgctttccctctcgtctgtgtacggtgtgattgttgtgtgtttcagaatctctattcagaaccaatagctggtaatgcctgctggctcgctgccctcaagttagcctctgaacgtgccctgcacctagagaagcagccttctcacccgcctcacctggctgctccagcggccaggccagccacctgaccatgaccattgctgatgtgcaacaggccttaattgaaaaaacacacaagtacatacatgcacatgcgcgcacacacacaggtgatttcacaggtagatctggtccctcttgctgtctccaatgctctagaaagcagcaagtaggcagctgacagtgttcccagggtgagtggcatctcccctcatcatcagaaagattcagtcaaattttggcccagagctgaagaggaggacttgggaatgtcagggaaaacatgacagggctaggggttaacaggcttctttggccaggagatggtttccagttcaccgtcaacccaaaagctctcttcaggtcatggcaaacagaccagggctgtgggtgtggctgtgcttggcactgactcccccacaggccgctgtccaggttggctcaggattccagctgccatccccaggcaggcccctccgctggctcggctgctttcacaatcaccatgtctgtctattagagactgtgccattcaaggagacggggtccccgggggtgcagacttgtaaaattttttaatttttcaacttggctgaactggtccccatcaacaggaaaagccttcggaagtgaatttacagatttctcccatgtttgaaattaacataacatgaacccagaaggcagagcttgcagtgagctgagatcgcaccagtgcactccagcctgggcaacagagtgagactctgtctaggtaggtaggtaagaaggaaggaaggaagaacagacctggatggagttattgggaacatgtcttatcaatgttgaagggccccctatcactgtagggagacatccacgtgggttgttttcgtctgctgtgaaaatctagggttggaatcatggaagcaaactgcaggaattcttaatcatcctgctcacgtggtgggcatcagagggtgtctgcttggcccccacagcactgggacagtcagagaggccatgagtggatgacgccctgatcactgccctttgcagtccaggaatacctcactgggctggggccataccctgtgccctctggaagacaagcctgcgcacttactatgtgccagatgccatgcacagtgccctagttccttgctgtagcaccaacacgtcccacgctggtgcttaaatgcacgcaaacaactttggtggttgtggcccgaaaagctcaaatgttaaagttaagcagtcaggcaagctagaagaggtgaggagcctcctagaaaactcattcgatgacacgcgcttccctcacctattcagatacttgccgagtgcctgccacttgcctggccctgtacccagggcccatctgggagccattcctgctatagctgggaccacttgtgaaacggctagttgtgcctaacagacatgctcagattcacaaaatgaattcagaacacttacctgtcccacccgtgaaagtgaccttggaggtgtcattgccccccaccaccccagtttctagtccaagccaacagctggtgctagatagatgcttgatgaatgagcagatttgactgttagttactctgtacctaaaactcctatctttacatcaaagccctgacagatttgcccttgacagactgaaatccggggctgctgcagggttcacctccaggaggcaccattcacgacactgtcccataaatggtaatgggctcccagggatactgtttacatagactgcactgagaacggtgacccttaggtttgtacaatgaggtaccctgttgaatgaccctaaaccagcctccaaaatgtgcaggatcccacattggtcagcgccaaccctgagcacaggatctaaaactatagatgatatggccaccctggccacagctggaaccaagctggtggcccaagagagagcctcttcttggaattgcatgtcagtttctcatacgcagtttcttcctatttttcccatttcccgttttaaagctagtggcatacctcacagtcaaataaccaagtggtcagtgtctcgacaatgtgcagtaacgaggtgggggctgcaagggtgaggggctcagtcaccttaacaaggcaggagacctcccacaaaaggctgatgtgtcgtccccagggccagctggacaagggcatgcagcgcaggggtagggggatggaaatattttctctcccgtaaactctgacttcatgtgagcaggcatggggtctccctgagagctgataaccgggaaaaccaaaaccaataatattcctaataataatactagaatgtaagaataatcatgtgtttttcactgaccgctgttgctctgcttttgtctttatatacagtagtttttataacaatgtccctaggttttaataaaggagtgtcatgtcaactgttccc

SEQ ID NO: 2965 - DNA, 3840 bp, Homo sapiens
agagctgccagggattggccagaacttggctttgagtcacaaagctgctgcggcaccagggctccaagactggccgttcagactgctaggtttagcttcaggggcagcccagggcagtgttgctgcatattgcatggatgaaaggctgaaggctgcctcctcttgcaggctggcttctgagattgcaccttcttctcctgctactcctccaaatctatgacccttcaaggcagagctgacctgtccggtaatcaaggcaatgcagccggccgcctagctacagttcacgagccagttgtcacccagtgggcggtgcatcctccagcccccgctcaccccagtctcctggacaaaatggagaaagcgcctccacagccccagcacgagggcctcaagtccaaggagcatcttccgcaacagcctgccgaaggcaagacggcgtcccgccgcgtcccacgcctccgggctgtggtcgagagccaggccttcaagaacatcctggtagacgagatggacatgatgcacgcccgtgcagccacgctcatccaagccaactggaggggctattggctccggcagaagctgatttcccagatgatggcggccaaggccatccaggaggcctggcggcgcttcaacaagagacacatccttcactccagcaagtcgttggtaaagaaaacgagggcggaggagggggacataccttatcacgccccacagcaggtgcgcttccagcatccggaagagaaccgccttctgtccccgcccatcatggtgaacaaggagacccagttcccttcctgtgacaatctggtcctctgcagaccccagtcgtcccccctcctgcagcccccagcagctcagggtaccccagagccctgtgtgcagggtcctcatgctgccagagtccgggggctggccttcctgccacaccagacggtcaccatcagatttccctgcccagtgagtctggacgcaaaatgccagccatgcctgctgaccagaaccatcagaagcacctgcctcgtccacatagagggtgactcagtgaagaccaaacgtgtaagtgcccggaccaacaaagccagggctccggagacaccattgtccagaaggtatgaccaggcagttacgagaccatccagagcccaaacccagggccctgtgaaagcagagacccccaaagcccccttccagatatgtccagggcccatgatcaccaagactctactccagacatatccagtggtctccgtgaccctgccacagacatatccagcgtccacgatgaccaccaccccacccaagactagcccagttcccaaagtaacaataatcaagaccccagcccagatgtatccggggcccacagtgaccaaaactgcacctcacacatgccccatgcccacaatgaccaagatccaggtacaccccacagcctccagaactggcaccccacggcagacatgccctgcgaccatcacggcaaagaaccgacctcaggtttcccttctggcttccatcatgaagagcctgccccaggtatgcccggggcctgcgatggcaaagaccccaccccagatgcacccggtcaccaccccagccaaaaacccattgcaaacatgtctgtcagccacaatgtccaagacttcatcccagaggagcccagttggggtgaccaagccctcaccccagacccgcctgccagccatgataaccaagaccccagcccagttacgctcggtggccaccatcctcaagactctgtgtctggcctctccaacagtggcaaatgtcaaggctccaccccaagtggcggtagcagccggaactcccaacacctcaggctccatccatgagaacccacccaaggccaaggccaccgtgaatgtgaagcaggctgcaaaggtggtgaaagcctcatccccctcctatttggctgaggggaagatcaggtgcctggctcaaccacatccgggaactggggtccccagggctgcagctgagcttcctttggaagccgagaaaatcaagactggcacccagaaacaggcgaaaacagacatggcatttaagaccagtgtggcagtggaaatggctggggctccatcctggacaaaagttgctgaggaaggggacaagccacctcacgtgtatgtgcctgtagacatggctgtcaccctgccccggggacagctggctgccccactgaccaatgcctcatcccagagacatccaccctgcctgtcccagagaccactggccgccccgctgaccaaggcctcatctcagggacatctgcccactgagctgaccaagaccccatccctggcccatctggacacctgtctgagcaagatgcattcccagacacatctggccacaggtgccgtgaaggtccagtcccaagcgcctctagccacctgtctgaccaagacgcagtcccgggggcagccgatcacagacataaccacgtgcctcatcccagcgcaccaggctgctgatctcagcagcaacacccactcccaggtgctcctaacagggtccaaggtgtccaaccacgcctgccagcgcctcggtggcctcagcgccccaccctgggccaagccagaggacagacagacccagccacagccccacggacacgtgccggggaagaccactcaggggggaccatgcccggcagcctgtgaggtccagggtatgctggtgccgccgatggcacccaccggccattccacatgcaacgttgagtcctggggagacaacggagccacacgtgcccagccatcaatgcccggccaggcggtgccctgccaggaggacacgggccccgcggacgctggtgtggttggtggccaatcgtggaaccgcgcatgggagccagccaggggtgctgcgtcctgggacacctggcgcaacaaggcggtggtgcctcccaggcggtccggggagccaatggtgtccatgcaggctgcagaggagatccgcatcctcgcagtgatcactatccaggcgggcgtccgtggctacctggcgcgtcgcaggatccggctgtggcaccggggggccatggtcatccaagctacttggcgcggctaccgtgtgcggcggaacctggcacacctctgcagagccaccacgaccatccagtctgcctggcgcggctacagcacccgccgggaccaagcccggcactggcagatgctccaccccgtcacgtgggtggagctgggcagccgggccggggtcatgtctgaccgaagctggttccaggatggcagagccaggacagtatctgaccatcgctgcttccagtcctgccaggcacacgcttgcagcgtctgccactccctgagctccaggatcgggagcccgcccagcgtggtgatgctagtgggctccagccctcgcacctgtcatacctgtggacgcacacagcccacccgtgtggtgcagggcatgggccagggcactgagggccccggggcagtgtcttgggcctccgcctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggcgaggccaccatacccggagctgtctgaagaacacagaggcgctcttgggaccagcagacccctcggccagctcacggcacatgcattggcctggcatctaggaccctggctccctgcagtggggacttcgtgggaggcactcatggctctctgggtctaatgaataaagtcctccacagcct

SEQ ID NO: 2966 - DNA, 5725 bp, Homo sapiens
atgtcagatgatatcaggaaaaggtttgaatttccaaattctcttatccaatcacaggctgtgggtcatcttattgctgcagtcctaaaggaaaatggtttttcagaaaagattcaccaatctacaaatcagactcctgctttgaacttgctgtgggagaagtgttgcagtgacaatgtagtggttcgaacagcctgctgtgaaggtctggtggcactcgttgctcaggatcatgcagagttcagctatgttctcaatgggatactcaacttgattccatcaaccagaaatacacatggcttgataaaagccattatgcacttactacaaatgcaagctcttaaggaaggacaaggtggggaaaagaatattcagagtatatataccattagaaatcatcctcatcctttgataactgtgcttgaacacagacctgattgctggccagtgtttttgcagcagctgacagcgtttttccagcagtgccctgaaaggttagaagtttcatgcattcaaataatggcaccatttctgtggtatctgtattgtgaaccatctcagttacaagaatatgctaaactccgactagccctgctgaaagtcttacttcaaccccaggttctttgtgacaaagatcaaccatcaatactggaacagcagatacttcaactgtgttgtgacatagttccatgtttgcaggtaaaagatttgatacagacaacagaggcgatgatgtttattgaggaagtatgtttaagccttttgcgtcatcctgttttctggaaaattcagcttacccagatgagtcttcagctgctgtgtgtcagtgaagtcagcttaaagataactggtgaatgttcatcttcaattcaccttttagagcacagtgttgaacttctgaaggaggattttcctgttgaactggtcataattggaatagctttactacttctacagactccagcaagtcagcagaagccaatcttaaatctagctttgaagctcctctctgttactgaggatcagaaaatcccaaagtcctctctgctgctagtgatgccaattctgcagatactatcttctactgccttggaagactgtatatctgtggatgaagaaggtccctctaggcagcagttggctctaaaccttttggaaatgatacagcaggaatgttacagagatgaccaccaaaagctctcctacaagcttgtgtgccctgtaaccagtatgtatggtacaatatttacagcctggaggattcttgaagtaatgacagactcgtctgctgcaagtgactggttggcttcagtagagtcattgcttcctattactgctgtgatccctgcgcctgcctttcttctgctggctcacctccttgttgaagacaaaggacaaaatcttcaccaaatactcaaggtcactacagaattagcccaagcagattcctcccaggtgccaaatctgattccagttttgatgttcaaattgggaagaccactggaacctatattatataatgatatattgtatactttacctaagcttggtgttcacaaggtgtgtataggacaaattctacgaataatacaactacttggaaccacaccacgactaagagctgtcactttgcgcttgctgacatctttgtgggaaaagcaggaccgagtctatcctgaactgcagcgtttcatggctgtgtctgatgtaccttctctttcggtgggcaaggaagtccaatgggagaaactgattgcaaaagcagcatcaatcagagatatatgtaagcagaggccatatcaacatggtgcagatatgttggcagctatttctcaagtgttgaatgaatgcaccaagcctgatcaagctactccagcagccttggtattacagggtcttcatgcactctgtcaagctgaggttgtttgcattcgctccacttggaatgctctctctccaaagctgagttgtgacacaagacctctcattctgaagacactgagtgaactattttctctagttccttccttaacggtcaatacaactgaatatgagaattttaaagttcaagtcctcagcttcctctggactcatactcaaaacaaggacccaattgtagcaaatgctgcatatagatccctggccaactttactgcaggagaacacaccattcttcatctgcctgaaaagataagaccagaaattcccattcctgaagagttagatgacgatgaagatgttgaggatgtggatctttcagttcctggctcttgctatctcaaactgttgtcactcactccccctttggttttaccagctttggaggaattttttacatcacttgtgaagcaagaaatggtgaatatgcctcgtgggatatatcactctgcattaaaaggaggtgcccgctcagaccaaggaaagactgtagcaggaatccccaattttatattgaaaatgtatgaaacaaacaagcaaccaggactgaaacctggccttgcaggtggtatgttattttgctatgatgtttccatgtatcagagtaaagatggaaaaccattgaacagactgatggccagcagagggcgaagtttcaagcagacttcacttgctcttgtacatgaggttcatatccagctttcagagtggcaccgtgcaatttttcttccacaggcctggcttgcatacatgaatcgagcttatcatgccattttacagggaagactaggagagctggagttgcagttaaaacatggaaaagaagaacctgaggaggtgcagtacaaaaaaagcacagcctggctctgggttagagacatgctgactgatgagatcaccaaggcagctgcaaaggagagtccggtagtgaaaggcaatgcgctgttagctctaagcagccttgctgtcgtcgtatctagacatgaagccagcctctcctcagactctgacgggctcctggaggttcaacctaatttcctttcaatgaaagagtgggtttccatggtacttgatacactcttggtcattgtggatagccattaccaacccagagggcaacttctctcctggttttattataagtcctattctggtgaaaacacagctagtgccattgcccgttctgctgccgccacggctttgtctctccttgtgccagttttcattatctcttgcaaagagaaggttgaggaaatcctgaacatgctgactgccaggttacctgggaaaccaagtgctgatgagtctcaagccgtgcaaatccacatgggccttgctttagggatgtttctctctcgcttgtgtgaagagaaactcagtgatatatctggccaagagatgaaccttcttctgatgaagtcgttggatgccctggaaaattgctgctttgacactagtcttgaatacaacacgggctgtatattgggagttggacttgttctgtccctcatgagccacagcagccaaatgcagtcccgcgttcacgtagcagcattgctccggaagctgtctgcgcacgtagatgacagcgggagccagagcagaacgtttcaggaggtccttgcctacacacttagctgtgtatgtacatcagcgttcagtgctggaattattgaggctacagaggctgaggatgttatgaacaagcttcgactgttagtggagaatagccagcagacttcaggttttgccctggctttaggaaacatagttcatggattgtctgtgtgtggacatggaaaagctgaagacttgggcagcaaactactccctgcctggatcagaattgttctaacagagggcactcccacaatgctttgtctggcagctcttcatggcatggtggccttggtaggctctgaaggggatgtaatgcagctgaaatcagaagccatccagacctctcattttcaaggcagacttaatgaagtcattagaaccttaactcaggtcattagtgtctctggggtgattggtctccagtcaaatgcagtctggcttcttggacatcttcatctatctactctatcctcaagtcaaagtagagcctctgttcctactgactatagctacttgcctgaaagcagttttattggagcagctattggcttcttcattacaggaggaaaaaaaggtcctgaatctgtgcctccttcccttcttaaagtagtgatgaaacccatagcaactgttggagaaagctaccaatatcctcctgtgaactgggctgcacttctctctccacttatgaggctaaattttggtgaagagatccagcaactgtgccttgaaattatggtgacccaggcacagtcatcccagaatgcagctgcactattgggcttgtgggtgacaccaccactgatccacagtctgagtctgaataccaagagatatctcctgatatctgcacctctgtggataaaacacatctctgatgaacagatcctgggttttgttgaaaatttaatggtggcagtttttaaagcagcttccccacttggaagtcctgagctatgcccaagtgctttacacggtctgagccaggccatgaaactgcccagccctgcccaccacctctggagtctgctctctgaagctactgggaaaatttttgacctcctgccaaataagattcggagaaaggatctagagctgtatatcagcatagcaaaatgcctcttagaaatgacagatgatgatgccaatcggatcgcccaggttactaagagcaacatagaaaaagctgcctttgtcaaactgtacttagtctctcaaggacgattccccttggtgaacctgaccgatatgctgagcgttgctgtgcagcaccgtgagaaagaggtgttggcctggatgattctgcacagcttataccaggcacggattgtgagccatgccaatacgggcgttttgaagagaatggagtggctcttggaactgatgggttatattagaaatgttgcttaccagtcaacatcctttcacaatacggctcttgacaaggctttggacttcttcttgctgatatttgcaaccgcagtggttgcatgggctgaccacactgcccctctcctcctcggcctcagtgccagttggttgccatggcatcaggagaatggcccggctgggccagtaccaagcttccttggcaggagtccaatgcacagggtcactctgcaggaggttctcactctccttcccaatagcatggctctgctgctgcagaaagagccatggaaggaacagacccagaagttcattgactggctattcagcatcatggaaagccctaaagaagccctctcagcacagtccagggatcttttgaaagccaccctgctgtccttgagagttctcccagagtttaagaagaaagctgtatggaccagagcatatggttggtgaacagttttgcagtaaccagcagcattctcagctggatgaggaaaaccatataagtggaagaagtttttcagaattcatgcctggtattgctgagacatgatgcagagagttaagggtcatgaaaagatggccacatcactgacagcttgacacatgcctcctaagagaggagtgcattgctttagtacccgggccagttgagactgaaacaggaacttggattttctttatttggcttgagttcaatgtggagattttctttgtgaaagcttgaagatattatcttctccctgctaaattccagtaaaataatgttgtc

SEQ ID NO: 2967 - DNA, 6096 bp, Homo sapiens
gttcgagcttcccggctgctttgtttacctaatcaagcctgggcaatggcgggcgcccctcccgcagcctcgctgccgccttgcaggttgatctcagactgctgtgctagcaatcagtgagactccgtgggcgtaggactctccaagccagtgagatgaactcggtatctcagatggaaatgcagaaatcaccgtcttctccatcgctcacgctgggagctgtagaccggagctgttcctattcggccatctttgctcctccctgcaactaactccattcttaattgaccatcaaggaaatttccatccacacagattagcagttgaaaatgaagctgcacacatacatgtaagagaagcaaaaatgtcagatgatatcaggaaaaggtttgaatttccaaattctcttatccaatcacaggctgtgggtcatcttattgctgcagtcctaaaggaaaatggtttttcagaaaagattcaccaatctacaaatcagactcctgctttgaacttgctgtgggagaagtgttgcagtgacaatgtagtggttcgaacagcctgctgtgaaggtctggtggcactcgttgctcaggatcatgcagagttcagctatgttctcaatgggatactcaacttgattccatcaaccagaaatacacatggcttgataaaagccattatgcacttactacaaatgcaagctcttaaggaaggacaaggtggggaaaagaatattcagagtatatataccattagaaatcatcctcatcctttgataactgtgcttgaacacagacctgattgctggccagtgtttttgcagcagctgacagcgtttttccagcagtgccctgaaaggttagaagtttcatgcattcaaataatggcaccatttctgtggtatctgtattgtgaaccatctcagttacaagaatatgctaaactccgactagccctgctgaaagtcttacttcaaccccaggttctttgtgacaaagatcaaccatcaatactggaacagcagatacttcaactgtgttgtgacatagttccatgtttgcaggtaaaagatttgatacagacaacagaggcgatgatgtttattgaggaagtatgtttaagccttttgcgtcatcctgttttctggaaaattcagcttacccagatgagtcttcagctgctgtgtgtcagtgaagtcagcttaaagataactggtgaatgttcatcttcaattcaccttttagagcacagtgttgaacttctgaaggaggattttcctgttgaactggtcataattggaatagctttactacttctacagactccagcaagtcagcagaagccaatcttaaatctagctttgaagctcctctctgttactgaggatcagaaaatcccaaagtcctctctgctgctagtgatgccaattctgcagatactatcttctactgccttggaagactgtatatctgtggatgaagaaggtccctctaggcagcagttggctctaaaccttttggaaatgatacagcaggaatgttacagagatgaccaccaaaagctctcctacaagcttgtgtgccctgtaaccagtatgtatggtacaatatttacagcctggaggattcttgaagtaatgacagactcgtctgctgcaagtgactggttggcttcagtagagtcattgcttcctattactgctgtgatccctgcgcctgcctttcttctgctggctcacctccttgttgaagacaaaggacaaaatcttcaccaaatactcaaggtcactacagaattagcccaagcagattcctcccaggtgccaaatctgattccagttttgatgttcaaattgggaagaccactggaacctatattatataatgatatattgtatactttacctaagcttggtgttcacaaggtgtgtataggacaaattctacgaataatacaactacttggaaccacaccacgactaagagctgtcactttgcgcttgctgacatctttgtgggaaaagcaggaccgagtctatcctgaactgcagcgtttcatggctgtgtctgatgtaccttctctttcggtgggcaaggaagtccaatgggagaaactgattgcaaaagcagcatcaatcagagatatatgtaagcagaggccatatcaacatggtgcagatatgttggcagctatttctcaagtgttgaatgaatgcaccaagcctgatcaagctactccagcagccttggtattacagggtcttcatgcactctgtcaagctgaggttgtttgcattcgctccacttggaatgctctctctccaaagctgagttgtgacacaagacctctcattctgaagacactgagtgaactattttctctagttccttccttaacggtcaatacaactgaatatgagaattttaaagttcaagtcctcagcttcctctggactcatactcaaaacaaggacccaattgtagcaaatgctgcatatagatccctggccaactttactgcaggagaacacaccattcttcatctgcctgaaaagataagaccagaaattcccattcctgaagagttagatgacgatgaagatgttgaggatgtggatctttcagttcctggctcttgctatctcaaactgttgtcactcactccccctttggttttaccagctttggaggaattttttacatcacttgtgaagcaagaaatggtgaatatgcctcgtgggatatatcactctgcattaaaaggaggtgcccgctcagaccaaggaaagactgtagcaggaatccccaattttatattgaaaatgtatgaaacaaacaagcaaccaggactgaaacctggccttgcaggtggtatgttattttgctatgatgtttccatgtatcagagtaaagatggaaaaccattgaacagactgatggccagcagagggcgaagtttcaagcagacttcacttgctcttgtacatgaggttcatatccagctttcagagtggcaccgtgcaatttttcttccacaggcctggcttgcatacatgaatcgagcttatcatgccattttacagggaagactaggagagctggagttgcagttaaaacatggaaaagaagaacctgaggaggtgcagtacaaaaaaagcacagcctggctctgggttagagacatgctgactgatgagatcaccaaggcagctgcaaaggagagtccggtagtgaaaggcaatgcgctgttagctctaagcagccttgctgtcgtcgtatctagacatgaagccagcctctcctcagactctgacgggctcctggaggttcaacctaatttcctttcaatgaaagagtgggtttccatggtacttgatacactcttggtcattgtggatagccattaccaacccagagggcaacttctctcctggttttattataagtcctattctggtgaaaacacagctagtgccattgcccgttctgctgccgccacggctttgtctctccttgtgccagttttcattatctcttgcaaagagaaggttgaggaaatcctgaacatgctgactgccaggttacctgggaaaccaagtgctgatgagtctcaagccgtgcaaatccacatgggccttgctttagggatgtttctctctcgcttgtgtgaagagaaactcagtgatatatctggccaagagatgaaccttcttctgatgaagtcgttggatgccctggaaaattgctgctttgacactagtcttgaatacaacacgggctgtatattgggagttggacttgttctgtccctcatgagccacagcagccaaatgcagtcccgcgttcacgtagcagcattgctccggaagctgtctgcgcacgtagatgacagcgggagccagagcagaacgtttcaggaggtccttgcctacacacttagctgtgtatgtacatcagcgttcagtgctggaattattgaggctacagaggctgaggatgttatgaacaagcttcgactgttagtggagaatagccagcagacttcaggttttgccctggctttaggaaacatagttcatggattgtctgtgtgtggacatggaaaagctgaagacttgggcagcaaactactccctgcctggatcagaattgttctaacagagggcactcccacaatgctttgtctggcagctcttcatggcatggtggccttggtaggctctgaaggggatgtaatgcagctgaaatcagaagccatccagacctctcattttcaaggcagacttaatgaagtcattagaaccttaactcaggtcattagtgtctctggggtgattggtctccagtcaaatgcagtctggcttcttggacatcttcatctatctactctatcctcaagtcaaagtagagcctctgttcctactgactatagctacttgcctgaaagcagttttattggagcagctattggcttcttcattacaggaggaaaaaaaggtcctgaatctgtgcctccttcccttcttaaagtagtgatgaaacccatagcaactgttggagaaagctaccaatatcctcctgtgaactgggctgcacttctctctccacttatgaggctaaattttggtgaagagatccagcaactgtgccttgaaattatggtgacccaggcacagtcatcccagaatgcagctgcactattgggcttgtgggtgacaccaccactgatccacagtctgagtctgaataccaagagatatctcctgatatctgcacctctgtggataaaacacatctctgatgaacagatcctgggttttgttgaaaatttaatggtggcagtttttaaagcagcttccccacttggaagtcctgagctatgcccaagtgctttacacggtctgagccaggccatgaaactgcccagccctgcccaccacctctggagtctgctctctgaagctactgggaaaatttttgacctcctgccaaataagattcggagaaaggatctagagctgtatatcagcatagcaaaatgcctcttagaaatgacagatgatgatgccaatcggatcgcccaggttactaagagcaacatagaaaaagctgcctttgtcaaactgtacttagtctctcaaggacgattccccttggtgaacctgaccgatatgctgagcgttgctgtgcagcaccgtgagaaagaggtgttggcctggatgattctgcacagcttataccaggcacggattgtgagccatgccaatacgggcgttttgaagagaatggagtggctcttggaactgatgggttatattagaaatgttgcttaccagtcaacatcctttcacaatacggctcttgacaaggctttggacttcttcttgctgatatttgcaaccgcagtggttgcatgggctgaccacactgcccctctcctcctcggcctcagtgccagttggttgccatggcatcaggagaatggcccggctgggccagtaccaagcttccttggcaggagtccaatgcacagggtcactctgcaggaggttctcactctccttcccaatagcatggctctgctgctgcagaaagagccatggaaggaacagacccagaagttcattgactggctattcagcatcatggaaagccctaaagaagccctctcagcacagtccagggatcttttgaaagccaccctgctgtccttgagagttctcccagagtttaagaagaaagctgtatggaccagagcatatggttggtgaacagttttgcagtaaccagcagcattctcagctggatgaggaaaaccatataagtggaagaagtttttcagaattcatgcctggtattgctgagacatgatgcagagagttaagggtcatgaaaagatggccacatcactgacagcttgacacatgcctcctaagagaggagtgcattgctttagtacccgggccagttgagactgaaacaggaacttggattttctttatttggcttgagttcaatgtggagattttctttgtgaaagcttgaagatattatcttctccctgctaaattccagtaaaataatgttgtcaattttg

SEQ ID NO: 2968 - DNA, 5958 bp, Homo sapiens
gcgtcttttgccacgaacacctgcggcgtgccgaagttcctcttctctgccccggttccgggcggtccgctgggaggtggcgcccggagggacacccgtgcctggggtcggggccagtgctcttctcggagctccagaagttctgctgagaagcgcggcggcagcaagacgacttctccggagccgccgagctggagttagaggtggagctccgtggggccgggcccccggctgcggggcagcggctcctgcaggcggaggccccggcggagaatgagccggagccggaggtggtggtggtctcctggcagagcggtgggaccgggagcaagctgcggtggttcaccaccttgatgctgtgtgcctccttcctggggctgggattgagtgttgctatagtgggacccacgtttcaagatttggcaacaaacgtgaaccgaaatatcagtagtctgtctttcatttttgtgggtcgtgccttgggatatttgagtggctctgtgattggtggatttcttgtcgatgtcatgaattattttttacttttgggaatctcaatgtcggctaccaccgttggtctttatcttgttcctttttgcaagacagcaatattactcactgtcatgatgtctatcttcggtgtttcaattggcattctggatacaggtggtaacgtccttatcttggctatttggggggacaaaggagccccacatatgcaggccttacacttctcttttgccttgggtgcctttttggctccactgctagctaaactggctttgggtccgacagcgtctgctgaaaaccacacagagtctgacttccatcctgcactcaaccaatcatctgatgctgactcagaagctctgtttggagtacctaatgataagaatttactgtgggcttatgctgttatcggtacttacatgttcttagtttctgtcatttttttttgtctgtttttaaagaatagctcaaagcaagaaaaagcaagagcatctgctgagacatttcgaagagcaaaatatcacaacgcccttctttgtctcctttttctgttcttctttttttatgttggagctgaggtaacatatggctcttatgttttctcatttgcaaccacccatgctggcatgaaagaaagtgaagctgctgggttgaactccatcttctgggggacatttgcagcctgcaggggcctggcaatcttttttgctacctgtttacagcctggaaccatgattgtgttgagcaacattggcagcctgacttcatctttatttctggtgctttttgacaagaacccaatttgtctctggatagcaacttcagtgtatggggcttcaatggcaaccacatttccgagtggtgtttcttggattgagcagtacacgaccatccatgggaaatctgcagcattttttgtaattggtgcttccctgggagaaatggctattcctgcagtcattggaattcttcaaggaaaataccctgatttgcctgtagttctgtatacctctttgggagcatcaatagctactggtattttatttcctgtgctatataaattagccacttcacctcttgatcgccagcgaaaagaagacagaaagagtgaggaccagaaagctctgctctctagctccgggctaaatgaatatgaggaagagaatgaagaggaggatgcagaaaaatggaatgaaatggattttgaaatgattgaaacgaatgatacaatgaggcattctataatagagacatctagaagtagtctgacggagcccacagctgaagtctataatcaatacccatcaaatgcactggtgtttgagtcttctccttttaatactggcagtgcccatgtgaagcacttgccagaaaccaggacaaaagggactaacgtttagagaagatggattactcactgacatctttgaataactgccacttctaaggacgccattcagagcagagcattagcagaatttcaccatgctttggggattaaaatttttaggtccatattatagcaaatgctaaaaatttttgaaatgttctgtaattcccagagtcttccataaataaccaaatggtctcatacacgtacaataggatcttgttataacgctatcatttgacatgtgactgattaggaaatattttatggtctccacccctcagagcacccaaagaaggcattgtttttgagaaggggggtattctcagaatgagaccatgtaggagttgaattgattggttgaacaaattatcaggtatcaatatttttccaggaaagttgaggagaatagtttcataaaagagaaatgggccgggtgcagtggctaaagcctgtaatcccagcactttgggaggccgagacgggcagatcacgaggtcaggagatcgagaccatcctggctaacacagtgaaaccctgtctctactaaaaatacaaaaaattagccaggcgtggtggcaggcacctgtagtcccagctacttgggaggctgaggcaggagaatggcgtgaacccgggaggtggagcttgcagtgagccgagatcatgccacaccgtactccagcctgggcgacatctagactccgtctcaaaaaagaaatggagaggtatttttattaattgctttaccttatctgtagggttggatcaaagaatgtaatgactcatttgatttctaatttcaatgaagagaacacagaacagggcccaaggggtcgggcttcaagccttgacttcttctagccctgcactctgtcacttaacgtaggccttgtttatctcgcctcctgatctgtgattctagaaatgaaaatgagatgatttccaaattgggaatctgtaagttttaaagtttgtgcaaaatgtctgctagaaattagtacaagtgacagcatgttcttcatttcaaatgagaagtgaaaccaaaatgataaatagctttaagaatgtgctaatgataaatgattacatgtcaatttaatgtacttaatgtttaataccttatttgaataattacctgaagaatatattttttagtactgcatttcattgattctaagttgcactttttacccccatactgttaacatatctgaaatcagaatgtgtcttacaatcagtgatcgtttaacattgtgacaaagtttaatggacagttttttcccatatgtatatataaaataatgtgttttacaatcagtggcttagattcagtgaaatacagtaattcattcaattatgatagtatctttacagacattttaaaaataagttatttttatatgctaatattctatgttcaagtggaatttggagacactatgttctaattttaagaactgtttcagtgttattagattagtagtagggctgtagatggggtctttcgaggtcctttgcctacctcagtaacagaggctgggtctgagccttgctcgagattagctcttcaccaggtctgtgtggtaatcatatcgtagttaccgtaggtcacgctgcaagtgtaatttacagtgaggcatagtcttttccagtgattggaatacttgtgtcaccgatccagggtttctctttcctgagtctgaaatacctgggaaaccagttagaaggtgactgggtagcctaggagtcaaggatcagaaagggtacttcatatatatgtggcagaattggtgcaggtgatcctttgaaaaatgacaagaattgatgaaattttgtttacttcctccaattttttgctgaataacatctcctttctacctgattggagtaggcttgctttctcttacttaatttctataaatttgccattgttttgtctcaagtaaaatacagtgtctttcttgaccactgcccgcccattcaccttatatgcctgccacagtcttggttcatgtaataacctaacagctttggagatggcggtggagaagttaatggtaaaaaccttcttgctctttttatttttatttatttattaggggtgggggatggtgtctcactctgtcactcaggctggagtgcaatgacgtgatctcagctcactgcaacctctgcctccctggttcaagcgattcttctgcctcggcctcctgagtagctgggattacaggcatgcgccaccatgcccagctaatttttgtgtttttagtagagagggggtttcatcatgttacctaggctgatctcaaactcctgatctcaagtgatctgcccacctcagcctcccaaagtgttgagattacaggcatgagccactgtgcccagcccttttgctctttttatagtgtaaatttccctcagttagaacttggaaattacttctgcttcacttactgccttttctcaggttgttggaatctaggcagtagcagttacttggcagctaggaggcttgctagaataggaattccaccttcagcatttactgttacagggtagaagatgcagctcagggagagaaggatgatgataagaacatggcagaaaatctcaaaatctactctggaaaattcactatgtttccacacaccaacatgtgaatcgtcatgagatcatagggcattgttaaagttccatattggaaggaaaagacttagtacaattctaagaattagcatttatcctgctgatcagttcttagctaagtgtctgctgatacctaagtaaccaatatacccaagtgttctattgctgggtaacacagtaccacacattgaacaccttaaaacaatagacatttggtaatgtctgtacaggctgtactgaagcggcctgtacagggccgcttcagtacaggaccttacctatgtagactgaggtacgtgtttcttgctgactgtcagctgggcaccactcagcttcgagaggcctcccacagttcttgccatgtggccttctcacagatgcctctcacaacatggcagtttcttcaaagcaagcaggagaatctctaaatgagtcttgtatgacattacgtcattatgggaataacatcccatcacctttgccatattctagcgtctagaagcaaggtatgagttccaacaaaactcaagggtagaggctagaacagggatgtgactcattgcggatcaccttagagcatgcctgccacactcgggtacctgcagaatagagattctcaaaagttctaaaaactgagctaagagcaggacatgatggctcacacctgtaatcccagctactcaggaagctggggtggaagtatctcctgaggtcaggagtttgagaccagcctgggcaatatagtgagacctctgtctctaaaaaatttttaaaagagaccccttctctaaaaaacaggaaggctgggcgcggtggctcacacctgtaatcccagcactttgggaggccgaggtgggcggatcacaaggtcaggagatcaagaccatcctggctaacacggtgaaaccccatctctactaaaaatacaaaaaattagccgggcgggcgtggtggcgggtgcctgtagtcccagctactcgggaggctgaggcaggagaatggcgtgaacccaggaggcggagcttgcagtgagccgagatggtgccactgcactccagcctgggtgacagagcgagactgtctcaaaaaaaaaaaacaaaaatattcaactatgagctggggaaaaaagcttcagcggtcactgaaagtgcttacaggtacagctagtatggggatggaatatgccccattagccaggccaacagatctcatataggagaatctgttttatgtttgttggacagtgggtgagttatcgcagagttatgccttttttttctgtcactattttatgtcccttatcactgtgcctttaacctactgaaatgcagttgaggccgggtgcggtggctcacgccaagatggcgccactacactccagcctgggcaacagagggagactccatctc

SEQ ID NO: 2969 - DNA, 2815 bp, Homo sapiens
tttgacggctggaggccaccgagaagaaggaggaagcaggggtggcggctgctgcggcggttgcggcgggggccggggtgggcgccgcggtccgggccgggcagtgaggcgcgggcggccgggccggtgggctgggcggcgggcccggcggccgccctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcagaagtgagtgtggatacaccagagtttgcattggaaggaatgagtgtcacgtggggagggaaggggccagtggaccttttgtaagctttccactcaataaaatgaacctgtatggcaaatacttgaaatggaactcactccttccactttccccctttcttctgtcccaggaaatagatcatcttttgaaaagactcttgtctaggaaaagttgtgtccttttcctaatttaacgtgttctttcttaatgaagttttaatttatttttgttgagattttgctagatggcttttgcatcccctgtagatggtgagtgttggcggtgatgtccatctcggcgttcggaggccccacggtcccgaggctgggccggggccccccagggtggctgtgctgctgcctgtaggagggtgcgggttgtgctgtcatcctcgggtttgcacgcccttttttaggagcctgtggacatctgtggttttgtactttggggcttcaggggaggtgtttaactttctagtgattgatgattgtcaggttttgaaataccaaagcttttttgttctgtttttaaataaatatctttcaaactttca

SEQ ID NO: 2970 - DNA, 1691 bp, Homo sapiens
gtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaacgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggaactacagatgcttcggctctttccgtgccctgccccacgcgtggtcagacccgagtgacccactgcccgtttctgtcacaggtaactccagacacctgcacgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccactagcaccacagtcaggccttgatgggatcttctagggagacaatagccctgtctcaaaaccgggttgccagctcccatgtaccagcagctggactctgaaggcgtgagtctgcatcttagggcatcgctcttcctcacaccacgaatctgaacatgcctctctcttgcttacaaatgtctaaggtccccactgcctgctggagagaaaacacacttgcttagcccacaattctccatttcacttgacccctgcccacctctccaacctaactggcttacttcctagtctacttgaggctgcgatcacactgaggaactcacaattccaaacatataagaggctccctcttaacacggcacttagatacgtgctattccacctttcctcag

SEQ ID NO: 2971 - DNA, 731 bp, Homo sapiens
agttttcttttagtaccttgtgccaaagagacatatccaaggttgagattagtttccattttctttgtactattttctggataataagacattagacatttgaagagatggagaatgaagatgggtatatgacgctgagtttcaagaatcgttgtaaatcgaagcagaaatctaaagatttctccctatatccacaatattattgtcttctgctcatatttggatgcattgtgatccttatattcattatgacagggattgacctgaagttctggcataaaaaaatggatttctcccagaatgtaaacgtcagcagtctatcaggacacaattacttgtgcccaaatgactggctgttgaacgaagggaaatgttactggttttcaacttcttttaaaacgtggaaagagagtcaacgtgattgtacacagctacaggcacatttactggtgattcaaaatttggatgagctggagttcatacagaacagtttaaaacctggacattttggttggattggactatatgttacattccaagggaacctatggatgtggatagatgaacactttttagttccagaattgttttcagtgattggaccaactgatgacaggagctgtgccgttatcacaggaaactgggtgtattctgaagactgtagctccacatttaagggcatttgccagagagatgcgatcttgacgcacaatggaaccagtggtgtgtaa

SEQ ID NO: 2972 - DNA, 2197 bp, Homo sapiens
ggagagcgaagctcctctgcactgggcccaggtgcgctcctcagcgtctccgggtggcggggcgcgcgggatggaggagtcttgggaggctgcgcccggaggccaagccggggcagagctcccaatggagcccgtgggaagcctggtccccacgctggagcagccgcaggtgcccgcgaaggtgcgacaacctgaaggtcccgaaagcagcccaagtccggccggggccgtggagaaggcggcgggcgcaggcctggagccctcgagcaagaaaaagccgccttcgcctcgccccgggtccccgcgcgtgccgccgctcagcctgggctacggggtctgccccgagccgccgtcaccgggccctgccttggtcaagctgccccggaatggcgaggcgcccggggctgagcctgcgcccagcgcctgggcgcccatggagctgcaggtagatgtgcgcgtgaagcccgtgggcgcggccggtggcagcagcacgccatcgcccaggccctccacgcgcttcctcaaggtgccggtgcccgagtcccctgccttctcccgccacgcggacccggcgcaccagctcctgctgcgcgcaccatcccagggcggcacgtggggccgccgctcgccgctggctgcagcccggacggagagcggctgcgacgcagagggccgggccagccccgcggaaggaagcgccggctccccgggctcccccacgtgctgccgctgcaaggagctggggctggagaaggaggatgcggcgctgttgccccgcgcggggttggacggcgacgagaagctgccccgggccgtaacgcttacggggctacccatgtacgtgaagtccctgtactgggccctggcgttcatggctgtgctcctggcagtctctggggttgtcattgtggtcctggcctcaagagcaggagccagatgccagcagtgccccccaggctgggtgttgtccgaggagcactgttactacttctctgcagaagcgcaggcctgggaagccagccaggctttctgctcagcctaccacgctaccctccccctgctaagccacacccaggacttcctgggcagatacccagtctccaggcactcctgggtgggggcctggcgaggcccccagggctggcactggatcgacgaggccccactcccgccccagctactccctgaggacggcgaggacaatctggatatcaactgtggggccctggaggaaggcacgctggtggctgcaaactgcagcactccaagaccctgggtctgtgccaaggggacccagtgatctgggctctgcctggtcctcagcctgccaggcagatgcagcaccccctacaggggaggccagttgagagcttgggcagcctcttcctggacccagttatccaggtcttcatgctctgctcaagggggccacatgagcgagcctaggagctggacttcaacccaggaagatgcatccgagggaaaggagattttctatggcctcaggcctgagtgccaatattagtctccagcttctgtggatgatcggtttgatgacattgggatggttgtttagcatttctgtgccttggtttcattaaaatgacaatttccccctagaggaaaaagacagggttaacaaccacagcggattccaatctgggttctcattccggctcatggaaatgagtctgccgttgttcagtggcagtgggacttggcagggataacgtcattgctgtgaattctacttcaggcagctgggtgtacatcggacacagcctaccggcagcctctggaaaattaaccaaggaaaaggagcggtcagccctggaaagaggggagagcaaggttttccttccccaccctgagagttggcaaagggttggcagacaggaaggttctgggtggagatcccgcatgtgggctggccagcccctggcacgctgatgcccaagggtgagacaaggcagagaggacagggccacctggcaggagaagccaggagagcaccccagcttggtaggtggaagctgaggagtctgagtgaaaaaggaaatcagagaaatgcaggcacgttccaggcagctcttctacccacagctgcagagacgaccaacctgaagatgtctccatgctggggtgcagtgaagaccttcaggctggaggatgtggctgacagagttgtgtagttcct

SEQ ID NO: 2973 - DNA, 1148 bp, Homo sapiens
ccgggtggcggggcgcgcgggatggaggagtcttgggaggctgcgcccggaggccaagccggggcagagctcccaatggagcccgtgggaagcctggtccccacgctggagcagccgcaggtgcccgcgaaggtgcgacaacctgaaggtcccgaaagcagcccaagtccggccggggccgtggagaaggcggcgggcgcaggcctggagccctcgagcaagaaaaagccgccttcgcctcgccccgggtccccgcgcgtgccgccgctcagcctgggctacggggtctgccccgagccgccgtcaccgggccctgccttggtcaagctgccccggaatggcgaggcgcccggggctgagcctgcgcccagcgcctgggcgcccatggagctgcaggtagatgtgcgcgtgaagcccgtgggcgcggccggtggcagcagcacgccatcgcccaggccctccacgcgcttcctcaaggtgccggtgcccgagtcccctgccttctcccgccacgcggacccggcgcaccagctcctgctgcgcgcaccatcccagggcggcacgtggggccgccgctcgccgctggctgcagcccggacggagagcggctgcgacgcagagggccgggccagccccgcggaaggaagcgccggctccccgggctcccccacgtgctgccgctgcaaggagctggggctggagaaggaggatgcggcgctgttgccccgcgcggggttggacggcgacgagaagctgccccgggccgtaacgcttacggactccctgaggacggcgaggacaatctggatatcaactgtggggccctggaggaaggcacgctggtggctgcaaactgcagcactccaagaccctgggtctgtgccaaggggacccagtgatctgggctctgcctggtcctcagcctgccaggcagatgcagcaccccctacaggggaggccagttgagagcttgggcagcctcttcctggacccagttatccaggtcttcatgctctgctcaagggggccacatgagcgagcctaggagctggacttcaacccaggaagatgcatccgagggaaaggagattttctatggcctcaggcctgagtgccaatattagtctccagcttctgtggatgatcgg

SEQ ID NO: 2974 - DNA, 2874 bp, Homo sapiens
ccgctcctctggctcgctcgccaactccgggccccagccgcgggcgggcgcacggcgggcggacagcatgctgagcctcctcgtctggatcctcactctctccgatactttctcccaagggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcatccccccagaggacaccaggattgacggaggccctgtgattctactgcaggcaggcaccccccacaacctcacatgccgggccttcaatgcgaagcctgctgccaccatcatctggttccgggacgggacgcagcaggagggcgctgtggccagcacggaattgctgaaggatgggaagagggagaccaccgtgagccaactgcttattaaccccacggacctggacatagggcgtgtcttcacttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcacagctgttccctgatattcaggggcattgctcattgctcccttctcggaccagccttcttcctcccaccatggcaggtggggagcaggtctcccagaaacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacaggg
